United States Patent 11,098,302 (IDENTIFICATION OF POLYNUCLEOTIDES ASSOCIATED WITH A SAMPLE) - sequence listing, part 102

SEQ ID NO: 350710 - DNA, 584 bp, Homo sapiens
  misc_feature: GZ8MTXP02G0UUD.10.27.C05.1.454.CMB.2.raw
  modified_base (288)..(288): a, c, t, g, unknown or other
  misc_feature (288)..(288): n is a, c, g, or t
  modified_base (428)..(428): a, c, t, g, unknown or other
  misc_feature (428)..(428): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggctattataacttgtctcctggtatcaacacgcccagacaaacgccccaanactcttgatttatgaagtcaagtaagcggccctgtaggggtttctagtcgtcttccgtctgccctccaagtctggcaacacggcctccctgacaatctcgtggctccgaggctgacgacgaggctagaaattattactgnacgctctatatagtagtagtggtcgtcctacgtttacgtaacggggttttcggacggggtaacgggaccgagggtccgtacggtaacccgtaccgttaaaacgtccgaaccggtacccgaaacggcccgttcccggtaccccccgtcggttacccg

SEQ ID NO: 350711 - DNA, 579 bp, Homo sapiens
  misc_feature: GZ8MTXP02HGD3N.10.27.C05.1.454.CMB.2.raw
  modified_base (288)..(288): a, c, t, g, unknown or other
  misc_feature (288)..(288): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacacgcccagacaaagcccccanactctgatttatgaagtcagtaagccgtccctcgaggggtttctagtcgtcttcctctgtcctcaagtctggccacacggcctcctgaacactctctggctccaggctgacgacgagctagatattacgtgacagtctactatagtagttagaagtggttcgtccttacgttttacgtaacgggtttttcgggacgggttaagggacccgtaagggcttacggtacccgttaccgtaaacggttccgaacggcccaaacgggtccctccggtcccccgttacggttccccg

SEQ ID NO: 350712 - DNA, 839 bp, Homo sapiens
  misc_feature: GZ8MTXP02GRL4Y.10.27.C05.1.454.CMB.2.raw
  modified_base (290)..(290): a, c, t, g, unknown or other
  misc_feature (290)..(290): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgcccccanactctgtatttactagaagtcagtaagccggccctgacggggtttctagtcgtcttcccgtctgtcctaccaagttccgtgggccaaaaccgtccggggcccccttccccgtacggtaacctaaaacttcccgttcccgttcgggggtacccttacccgaaacggggtcccgttacgggaaacccggtaccgggaaacgggggtacccttaacgggtaaaagtttaactttaaaccccgttggacccgtaaacgggtcccgttaccgtaaactttaaacgttcgggtttaaaacggttagttcgggggtttaccgttccccgttttaccggtttttaaccgggttaaaacgggggtttttttccgggggaacccgggggttaaacggggggtaaaccccgtaacgggggtcccgtttaccggggtaacccccgggttttaacccgttaaaaccgggtttaacccgtaaaacccggggaacccccggtaaaacgggggttaccccggttaccccggttaccccccccggtttacccggggtttacccccg

SEQ ID NO: 350713 - DNA, 580 bp, Homo sapiens
  misc_feature: GZ8MTXP02GBBBQ.10.27.C05.1.454.CMB.2.raw
  modified_base (301)..(301): a, c, t, g, unknown or other
  misc_feature (301)..(301): n is a, c, g, or t
  modified_base (442)..(442): a, c, t, g, unknown or other
  misc_feature (442)..(442): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaaacacgcccagacaaacgccccacactctgatttangaagtcagtaagccggcctgtagggtttcagtcgcttcctctgcctcaagtctggcaacacggcctccctgacaatctcgtcggctccgagctgacgacgaggctagaatattaactgacagctcatatagtagatcggtntccttcgtttacgtaacggttttcgggacgggtacgggaccgtaacggtccgtacggtaacccgttacccgtaaacggttaacgaccggacccgtaaaacgggtcccgtacccggtccccccgttcgggttaaccccg

SEQ ID NO: 350714 - DNA, 650 bp, Homo sapiens
  misc_feature: GZ8MTXP02J0USX.10.27.C05.1.454.CMB.2.raw
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatggttggctattataacttgtctctgatcaacacgccagacaaacgccccanactctgtatttangaagtcaagtaacgcggccctcgtaggggtttctaggtcgctttccctctcgccctacctaagtccttaggtaccaccggtccctccctagaactaactccgtcgtcggggtccttacccgacgggtctaggaaccgacggacgggtaccttaaggaaaattacttaacgtcggactaacggccttactaattacgttaggttaagtagttacgggtccgttaccgtttacgttttaccggttaaaaggggtttttccgggacggggttaacgggaccgacgggtcgtacgtacccgtaccgtaacgtccgaacgtacccgaacgtccgtccgcccccgtaggtctacccg

SEQ ID NO: 350715 - DNA, 603 bp, Homo sapiens
  misc_feature: GZ8MTXP02H85SJ.10.27.C05.1.454.CMB.2.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (456)..(456): a, c, t, g, unknown or other
  misc_feature (456)..(456): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctgtatcaacacgccagacaacgccccacactcttnatttangtaagtcaagtaagccggtccctgtaggggtttctacgtcgtcttcctctcgcctcaagtctgcaaaccgacggccctaccctgacaattcctcgtgggcctccgacgcgtgaccgacgaggtctagtaattattacgtgacacgtctcattatgtaangttgggtctccctttacgtttacgttaacgggttttcgggacgggtaacgggtacccgtaagggtccttacggacccgtttaccgtaaacgttccgaaccggtaccccgaacgggtccctccccggtccccccgtttacggtacccc

SEQ ID NO: 350716 - DNA, 620 bp, Homo sapiens
  misc_feature: GZ8MTXP02H1LC6.10.27.C05.1.454.CMB.2.raw
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggctctgtctgccctgactcagcctgccctccgtgtctgggtctcctggacagtcgtcaccatctcctgcactcggacccagcactgatgtggctattataaccttgtctcctgtatcaacacgccagaccaacgcccccacactcttgtatttatagaagtacaaggtaacgccgtcctacgtacggggtttctagtcgtccttctctcgcctacagttctcgacaactacccggtccctccctagacctaactccgtcgtcggcctccgaggctacggaccgagacggactagtaattagttctgactagtcctatagtagtagtaagttgtggttcgtccgtttacgttttacggtaacgggttttccgggacgggtacggtaccgacgggtcctaccggttaacccgtaccgttaaacgtccgaaaccggtaccccgtaacgggtccccttcccggtacccccgttccgg

SEQ ID NO: 350717 - DNA, 620 bp, Homo sapiens
  misc_feature: GZ8MTXP02IFYNY.10.27.C05.1.454.CMB.2.raw
  modified_base (261)..(261): a, c, t, g, unknown or other
  misc_feature (261)..(261): n is a, c, g, or t
tcagcatagtagtgcacgaccggtgctcgatttagacgcgatcgaagggtttggggagggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactcggacccagcactgatggttggctattatactgtctctgtancaacaaccgccagaccaacgcccccactactcttagtattatagtaagtacaagtaacgccggtacctcgtaggggttctagtctccttctcctcgtcctactacgtctcggaccaacgacccgtcctaccccgtagaacctactacctcgacggtcctccgtacggcgtacggaccgacggtacgtacctagtaacttaacgttacgtgacgtaacgtactacgtaaagtagtagtaagtagttacggtcgttaccgttcgtttaacgttacgggtttcgggacggacggtaaccgacggtacgtaccgtaccgtacgtaacgtcgaaccgtccgaacgtccgtaccgtcccgtaccg

SEQ ID NO: 350718 - DNA, 624 bp, Homo sapiens
  misc_feature: GZ8MTXP02I65D3.10.27.C05.1.454.CMB.2.raw
  modified_base (295)..(295): a, c, t, g, unknown or other
  misc_feature (295)..(295): n is a, c, g, or t
  modified_base (459)..(459): a, c, t, g, unknown or other
  misc_feature (459)..(459): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatgttggcattataacttgtctctgtatcaacacgccagacaaacgccccacactctgatttangaagtcagtaacgccgccctgtacgggtttctagtcgtcttcctctcgcctcaagtccgtaggccaacgaccggccctcctcgaactaactctcgtgggtcctcccgaggtctagaccgacgaggcttagaaattacttacgtgcagtctacgatagtagtagngtaggtctcctttacgtttacgttaacgggttttcgggaccggggtaacggggtacccgtaagggtaccgttacggtaaccccggttaccgttaaaaggttcccgaaccggaaccccggtaaacggggtccttaccccgggaccccccgttacgggtttcccccg

SEQ ID NO: 350719 - DNA, 609 bp, Homo sapiens
  misc_feature: GZ8MTXP02FWIG7.10.27.C05.1.454.CMB.2.raw
  modified_base (254)..(254): a, c, t, g, unknown or other
  misc_feature (254)..(254): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctccgtggacagtcggtcaccatcctcctgccactcggaccagcactgatggtggctattataacttntctctgtactacaacacgccaagacaacgccccanacttctntattanagagtcgagtacgccgtcctgtaggttctagtcgtacttctcctcgcctacgagtcacgccaaccgcccggtcctaccctgaactactccgtcgtcggtaccctccgtacggtcgtacgaccggacgtacggactacgtaaacgttacttaccggacacgaacgtcctataagtagtaccggtagacgttcgtcgttcttacgttaggttaacgggtttcgggacggacgggaccaggtaccgtaccgttacgtaccgttaggcccgaacgtcccgaacggtcccctccgtaccccgtcggttaccc

SEQ ID NO: 350720 - DNA, 679 bp, Homo sapiens
  misc_feature: GZ8MTXP02H6F37.10.27.C05.1.454.CMB.2.raw
  modified_base (295)..(295): a, c, t, g, unknown or other
  misc_feature (295)..(295): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattatactgtctctgtatcaacacgccagacaacgccccacactctgtatttanagaagtcaagtaacgccgtcctacgtagggttctacgtcgtcttcctctccgtcctacgtaacgtccgttacggccaaaccgtaccggtcccctacccgtacgtaacctaaacttccgtccgtcggggacccttcccggaaacggtccgtaacgggaaaccggaccggtaacggtaccgtaaggtaaactttaacgttaaccgttggacctacgtaccttacgagtttaagtaggtaacgtgttacgggtcttccgtttacgtttacggttaacggggttttcggaccggggtacgggtacccgaggtacccgtacggtaccccgttacgtaaacgtccgaacggacccgtaaacggtccgtcccggtcccccgttacggtccc

SEQ ID NO: 350721 - DNA, 727 bp, Homo sapiens
  misc_feature: GZ8MTXP02IA1B2.10.27.C05.1.454.CMB.2.raw
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactggaccagcactgatgttggcattatactgtctctgtatcaacacgccagacaaacgccccanactcttgtatttangaagtcagtaacgcgcctcgtaggggtttctagtcgtcttcctctcgcctacaagtctggccaaacgccggcccttccccgtagaaccaaacttccgtacgtcggggcctacccgacggccgtacggaccggaaccggacggtaccgtaaggtaaacttaacgtttaaccgtacggtaccaacggtaccttactaaagttagttaggttaaaggtaacggttacggggtttccgttaccccgttttaccgttttaacccgggttaaaacgggggttttttcccgggggaacgggggtaaaccgggggaaccgtacggggtacccgttaccgggtaaccccggtttaacccgtaaacggttaacccgtaaaccggtaacccccggaaaccgggtaccccgttcccccggtaccccccgtttcggggtacccccg

SEQ ID NO: 350722 - DNA, 565 bp, Homo sapiens
  misc_feature: GZ8MTXP02GLP57.10.27.C05.1.454.CMB.2.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctgtatcaacaacgcccagacaaagccccanactctgatttangaagtcagtaacgcggcctcgtaggggttctagtcgcttcctctcgcctacaagtctaggccaaacacggcctccctagacaaatctcgtggctccaggctgacgacgaggctagaatagttacngcagctanatatagtagtagtgtcgtccttacgtttacgttaacgggtttcggacgggaacggtacgacggtacgtacgtacccgtacgtaacgtaaccgacggacccgtaacggtccgtccggtaccccgttcggtacc

SEQ ID NO: 350723 - DNA, 552 bp, Homo sapiens
  misc_feature: GZ8MTXP02F13II.10.27.C05.1.454.CMB.2.raw
  modified_base (315)..(315): a, c, t, g, unknown or other
  misc_feature (315)..(315): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctcctggtatcaacaacgcccagacaaacgcccccacactctcgatttatgaagtcagtaancggccctcgtagggtttcagtcgcttcctctgctacaagtctgcaacncggacctccngacaagtctctggctcgagctgacgcgagcngaacgtnttactgcagactcatatcgtagatggtgtccttgtttcgtaagggttttcgggacggtagggaccgaacggtcgtacgtaccgttcccgtaaaagtccgaacggacccgaaacgggcctccggacccccgtaggttccccg

SEQ ID NO: 350724 - DNA, 581 bp, Homo sapiens
  misc_feature: GZ8MTXP02GNRYX.10.27.C05.1.454.CMB.2.raw
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcaccatctcctgcactgacccagcatgatgtggctattataccttgtctctgtancaacacgccagacaaaccnccccanactctnattangaatacagtaagccgccctgtacgggtttctagtcgtcttcctctcgtcctaccaagtcctcggaccaaccgaccgtccctacccgtgaactaacttctccgtcggacctccgagcgtagacgacgagctaagtaaactattactgactacgtctactaagtagtaagtagtagtcggtcttcgttacgtttacgtaacgggtttccgggacgggtacggtaccgacggtctaccgtaaccgtccttaagaaccgacgaccgacggtcctccgtcccccttcggtaccc

SEQ ID NO: 350725 - DNA, 635 bp, Homo sapiens
  misc_feature: GZ8MTXP02GN8M1.10.27.C05.1.454.CMB.2.raw
  modified_base (281)..(281): a, c, t, g, unknown or other
  misc_feature (281)..(281): n is a, c, g, or t
  modified_base (450)..(450): a, c, t, g, unknown or other
  misc_feature (450)..(450): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacaacgccagacaaacncccccacactcttgtatttatgaagtcaagtaacgcggccctcgtacggggtttctagtcgtcttccgtctcgcctccaagttccgtggccaaacctacgggtccctacccgtagaacctaatcctcgtggcctccgaggctagacgacggagctagtaaatatacgtncgtacgtctacaattagtagtagtacgttgggtcttccttacgttttacgtaaacgggtttttccgggacgggtacgggtaacccgacggtaccgtaccggtaacccgttaccgtaaacggttaaccgtaaccgggaccccgtaaacggtcccgtacccggtcccccggtttacccggttacccg

SEQ ID NO: 350726 - DNA, 601 bp, Homo sapiens
  misc_feature: GZ8MTXP02F5ET0.10.27.C05.1.454.CMB.2.raw
  modified_base (452)..(452): a, c, t, g, unknown or other
  misc_feature (452)..(452): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcaccatctcctgcactcggacccagcactgattggtggctattactaacttgtctccgtgtatacaacacgccagacaaacgccccacacttcttagtatttatgtaagtcgaagtaacgccggcccttcgtacgggtttctagtcgtcttcctactcgcctcaagtctcgccaaacgccggcctcccgtagactaacgtctcgtggtccctcgacggctacgacgacgagctagtaatatactgactacnctactatagtagtagtcgtggtctccttacgtttacgttaagggtttccgggacggggtacggtaccgtacggtacctacggtacccgttacctaacggtaaccgaccgacccggtaaacgtcccgtacccggtccccgtccggtaccc

SEQ ID NO: 350727 - DNA, 620 bp, Homo sapiens
  misc_feature: GZ8MTXP02FXGAG.10.27.C05.1.454.CMB.2.raw
  modified_base (246)..(246): a, c, t, g, unknown or other
  misc_feature (246)..(246): n is a, c, g, or t
  modified_base (279)..(279): a, c, t, g, unknown or other
  misc_feature (279)..(279): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcaccatctctgcactgaccagcactgatgtggctattataacttntctctgtatcaacacgccagacaaacgccccanactcttagtactttatgaagtctagtaacgccggccctggtagggtttcagtcgtcttcctcgtcgtcctactaagtctacgggcctaaaccgaccggtccctaccccgtagaactaacgttcctacgtcgggtacctccgagtcgtacgacgacgacgactagaaactacgttacgtacgactaacgtcctactaagtagtagtagtacgttcggtacgttccttacgtttacgtaaacggggttttccggacgggtaaccgggaccgtacgggtacctacggtacccgttacgttaacgaaccgtacgaccgtacgcctccggccccgttggtaacccc

SEQ ID NO: 350728 - DNA, 571 bp, Homo sapiens
  misc_feature: GZ8MTXP02I3R7G.10.27.C05.1.454.CMB.2.raw
  modified_base (287)..(287): a, c, t, g, unknown or other
  misc_feature (287)..(287): n is a, c, g, or t
  modified_base (376)..(376): a, c, t, g, unknown or other
  misc_feature (376)..(376): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacacgccagacaaacgcccccanactcttgatttatgaagtcagtaagccggccctcgtaggggtttctagtcgtcttcctctcgcctccaagtctgcaacacggcctcccngacatctctggctcgagctgacgacgagctagaatattactgacagtctacatatagtagacgtggtcgtccttcgtttacgttaaggtttttcgggacgggtacggggtaccgtacgggtcgtacggtacccgttaccgtaaagtaaccgtacgacccgtaaacggccgtcccgacccccgttcggttaccccg

SEQ ID NO: 350729 - DNA, 576 bp, Homo sapiens
  misc_feature: GZ8MTXP02H9BT4.10.27.C05.1.454.CMB.2.raw
  modified_base (300)..(300): a, c, t, g, unknown or other
  misc_feature (300)..(300): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (412)..(412): a, c, t, g, unknown or other
  misc_feature (412)..(412): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttggctattataaccttgtctctgtatcaacacgccagacaaacgccccacactcttgatttangaagtcagtaagcggcctcgagggtttctagtcgtcttcctctcgcctaccaagtcctgcaacacggcctcctnacatcnctggctcagctgacgagagctagaatattacngtccagtctacatagtagtagagtgggtctccgttctttacggtaagggttttccgggacgggtaacgggtaccacgggtacgttaccggaacccgtttaccgtaaacggttccgaacggaccccgtaaaacgggtccctcccggtcccccgttacggtccccg

SEQ ID NO: 350730 - DNA, 551 bp, Homo sapiens
  misc_feature: GZ8MTXP02HS3E1.10.27.C05.1.454.CMB.2.raw
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcacccctcctcactcaggacacagggtcctgggccctgtctgccctgactcagcctgcctccgtgtctggtctcctggacagtcggtcacatctcctgcactggacccagcactgatgttggcattataacttgtctctgtatcaaacacgccagacaaacgccccanactctgatttanagaagtcagtaancgcctgagggttctagtcgcttcctctcgcctccaagtcngcaacacgcctccctgaacatcnctggctcaggctgacgacgaggctagaactattactgcagtctacatatgtagagtggtntccttctttacgttaaacggtttcgggacgggtacgggaaccgaggtcgttacgacccgttacccgtaagtaaccgacggacccgaaacgggtcctacccgtcccccgttcggttaccc

SEQ ID NO: 350731 - DNA, 570 bp, Homo sapiens
  misc_feature: GZ8MTXP02HY1OR.10.27.C05.1.454.CMB.2.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacngtcggtcacatctcctgcactggaccagcactgatgttggcattatactgtctctgtatcaacacgccagacaaacgccccanactctgtattatagaatcagtaagccgtcctcgtaggggttctagcgtcttctctgcctacaagtcctgcaacacggccctccctagacaatctctggctcagctgacgacgagctagaatattactgacacgtctactatattaggtagacgttgggtctcgttacgtttacgtaacgggttttacgggacgggtacgggtaaccgaacggtcgttacggtaacccggttactaaacgtaacgacgtacccgtaaacggacccgtcccgtaccccggttccggtaacccg

SEQ ID NO: 350732 - DNA, 515 bp, Homo sapiens
  misc_feature: GZ8MTXP02HMLNH.10.27.C05.1.454.CMB.2.raw
  modified_base (256)..(256): a, c, t, g, unknown or other
  misc_feature (256)..(256): n is a, c, g, or t
  modified_base (286)..(286): a, c, t, g, unknown or other
  misc_feature (286)..(286): n is a, c, g, or t
  modified_base (339)..(339): a, c, t, g, unknown or other
  misc_feature (339)..(339): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacttgtctcngtatcaaacaacgcccagacaaagccccanactcttgatttatgaagtcagtaagcggaccctcaggggtttcagtcgcttcnctgcctcaagtcctggcaacacggcctccctgacaaatctctggactccaggctgacgacaggctgaatatactgcancnatatgagatgtcgtctcttacgtaggttacggtacggaggacgacgacgtcgaccgtactacgtaacgacgaccgacgacgtccgtcccgtcgtcg

SEQ ID NO: 350733 - DNA, 612 bp, Homo sapiens
  misc_feature: GZ8MTXP02J1YIX.10.27.C05.1.454.CMB.2.raw
  modified_base (285)..(285): a, c, t, g, unknown or other
  misc_feature (285)..(285): n is a, c, g, or t
tcagcatagtagtgcacgaccggtgctcgatttagacgcgatcgaagggtttggggagggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataccttgtctctgtatcaacaacgccagacaacgccccanactcttagatttatagaagtcaagtaacggccgccctgtaggggtttctagtcgtcccttctctcgcctcaagttctcggacaaccaccggccctcctcgaacaactcctcgtggcctccgagtcctgacggacgaggtctagaattacgttactgctagctacaagttatggtaaagcgttgggtccgtcctttacgtttacgttaacggggttttccgggacgggtaacggggaccgtacggtccgttaccgtaaccccggttacctaaacggttccgaaaccggtacccggaacggtacccgtcccggtacccccctttccggg

SEQ ID NO: 350734 - DNA, 670 bp, Homo sapiens
  misc_feature: GZ8MTXP02HCISC.10.27.C05.1.454.CMB.2.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (511)..(511): a, c, t, g, unknown or other
  misc_feature (511)..(511): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagccggtcaccatctcctgcactggacccagcactgatggtggctattactactgtctctgtatcaacacgccagacaacgccccanctctatattangaatcagtacgccgcctcgtagggtttctacgtccgtcttccctcgtcgtccctacgaacgttcctcggacctaaaccgaccggtaccccttcccgtacgtaaacctaaacgttccgttaccgtcggggtcccttacccgtaacggggtctacgggaaccgtacggtaacggttcgtaccgtaagtaaacttacgttacgaacgtcgactacgttanaagttacggtagtaacgtgttacggttaccgttaccgtttagtttaacccggggttaaacgggtttccggggaaacggggtacggtaccggtcggttacgtaccggtaaccgtttacaacggtacgaccgttacggacttcccggccgtacccggttcg

SEQ ID NO: 350735 - DNA, 583 bp, Homo sapiens
  misc_feature: GZ8MTXP02GLGBG.10.27.C05.1.454.CMB.2.raw
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattatacttgtctcctgtatcaacacgcccagacaaacgccccanactctgatttangaagtcagtaagccggtccctgtaggggtttctagtcgtcttcctctcgcctcaagtctggcaacacggcctcctgacatctctggcctcgaggctgacgacgaggctagaatattactgcagctcattatagtagagttggtcgtccttcgtttacgtaacgggttttcgggacggggtacgggaccgtacgggtccgtacggtacccgttaccgttaaacgtaaccgtaacccggaccccgtaaacgggtcccgtacccggtaccccccggttcggttaccccg

SEQ ID NO: 350736 - DNA, 608 bp, Homo sapiens
  misc_feature: GZ8MTXP02HFVI0.10.27.C05.1.454.CMB.2.raw
  modified_base (301)..(301): a, c, t, g, unknown or other
  misc_feature (301)..(301): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgtcaccatctcctgcactgacccagcactgatggttggctattacgtaaccttgtctcctgtatcaacacgccagacaaacgccccacactctagtatttanagaagtcaagtaagccggtcccttgtacgggtttctagtcgtcttcctctcgtcctcaagtctggccaaccgacgtccctcctagactaactctcgtcggcctccgacggctacgacgacgacggacgtagtaacttaacgttactgactacgtctactatagtagtagtagttggtcgtcctttacgtttacggttaacggttttccgggacgggtacggtaccgacgggtccgtaccggtacccgttaccgtaaacgtccgaccgtacccgtaacggtccgtccccgtccccgttacggtacccg

SEQ ID NO: 350737 - DNA, 589 bp, Homo sapiens
  misc_feature: GZ8MTXP02GTJWW.10.27.C05.1.454.CMB.2.raw
  modified_base (307)..(307): a, c, t, g, unknown or other
  misc_feature (307)..(307): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcacccctcctcactcaggacacagggtcctgggccctgtctgccctgactcagcctgcctccgtgtctggtctcctggacagtcggtcaccatctcctgcactggacccagcatgatgttggctattataaccttgtctcctggtatcaaacaccgccagaccaaacgcccccacactcttagtactttanagaagtacagtaacgccggtaccctgtaggggtttctacgtcgtcttcctacgtgtccctcaagtctggccaaaccgcggtccctcctacgaacaatcctcgtcggctccgaggctcgacgacgagcgtagaactattacgtgacacgctacagtatacgtagatggtcgtccttcgttacgtaacggtttcggacggggtacggtaccgacggtcgtacgaaccgttaccgtaacgtaacgacgaccggtaacggtccgtcccgtcccccgtacgttcccg

SEQ ID NO: 350738 - DNA, 549 bp, Homo sapiens
  misc_feature: GZ8MTXP02HHOAY.10.27.C05.1.454.CMB.2.raw
  modified_base (299)..(299): a, c, t, g, unknown or other
  misc_feature (299)..(299): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataacttgtctcctgtatcaacaacgcccagacaaacgccccacactctgatttangaagtcagtaagccggcctcgtagggtttctagtcgtcttcctctgcctcaagtctagcaacncggcctcccngacatctcgtggctcgagctgacgacgaggctagaattattacncgcagtctactatatgtagagtcggtcgtccttcgtttacgtaacgggttttcggcgggtacggtacgacggtcgtacgtaccgtaccgtaacgtccgacgtacccgaacggtccgtccgtccccgtcggtcc

SEQ ID NO: 350739 - DNA, 582 bp, Homo sapiens
  misc_feature: GZ8MTXP02GEYJY.10.27.C05.1.454.CMB.2.raw
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (405)..(405): a, c, t, g, unknown or other
  misc_feature (405)..(405): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatgtggctattatacttgtctctgtactacaacacgccagacaacgccccanctctgtatttangaatcagtaacgccggtcctcgtagggttctagtcgtcttcctctgcctacgagtctggccacgcgcctcctagactatctacgtcggcctcgagcgtacgacgacgngtactagtaattactactgacacgtcctatagttatagtaagtcgttcggtcttaccgtttacgtttaacggttacggggtttaccgggacgggtacgggaccgtagggtccgtacgtacccgtacgttaacgccgaccgaccgtacgggtcctacccggtcccccgtggttacccc

SEQ ID NO: 350740 - DNA, 623 bp, Homo sapiens
  misc_feature: GZ8MTXP02IBK6Y.10.27.C05.1.454.CMB.2.raw
  modified_base (485)..(485): a, c, t, g, unknown or other
  misc_feature (485)..(485): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcacccctcctcactcaggacacagggtcctgggccctgtctgccctgactcagcctgcctccgtgtctgggtctcctggacagtcggtcaccatctctgcacgtgaccagcacgtgtagtgtggctattactaactgtctctgtactacaacaccgaccagacaaacgccccactatcttagtatttagagaacgtctaaggtaacgcccggtacccgttaggtacgggtttctaggtccgtcttcccgtctccgtcctaccgtaagtcgtacgacctaaccgtaccggtccctacccgttacgaacctacttcctccgttcggaccttccgacgtcgacgacggaagacggactagtattatacgtnaccgagtactatagtagtagtagtagttggcttccgttacgtttacggtaacgggtttccggacgggtacggactacggtcgtaccgaccgttacgtacgaacgacgaccgtacggccgtcccgacccgtcgtacccg

SEQ ID NO: 350741 - DNA, 597 bp, Homo sapiens
  misc_feature: GZ8MTXP02FPMMM.10.27.C05.1.454.CMB.2.raw
  modified_base (302)..(302): a, c, t, g, unknown or other
  misc_feature (302)..(302): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtcgtggtctcctggacagtcggtcaccatctcctgcactggacccagcactgattgtggctattataaccttgtctctgtatacaacaacgccagacaaacgcccccacactcttgatttanagtaagtcaagtaacgccggtccctcgtagggtttctagtcgtcttcctctcnctcaagtctgcacncgcctccngacatctcngtcncagctgacgtacgagctagtaaatattacgtgcgactctactataattagtagtagtcggtcgtcccttacgtttacgtaagggttttcggggacgggtacgggtaccggacggtaccgttacggtaacccgttaccgtaaaccggtaaccgaaccggacccggtaaaccggtcccgtacccggtaccccccgttcggttacccccg

SEQ ID NO: 350742 - DNA, 640 bp, Homo sapiens
  misc_feature: GZ8MTXP02HTNYT.10.27.C05.1.454.CMB.2.raw
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
  modified_base (499)..(499): a, c, t, g, unknown or other
  misc_feature (499)..(499): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactcggaccagcactgtagtggttggctattactaacttgtctctgtatcaacacnccanacaacgccccanactctgtattangatcagtagcgtcctacgnggttctagtcgtcttcctctcgcnctaagtcgtagccaacaccggccctacccgtagacaactcgtccgtgggacccttccgacggtccgtagtaccggaaccggtaggtacccgtaggtaaacttaagttaccgtacgggactaacggtcttactaaacttaaacaccaaaaccggtanaccggtacacctacctttacgttcgttaaccggttccggggaccgggaaacgggtacccgaagtacccggtacgtaacccgtaccggtaacggtaccgaccggtaccccgaacggtcccgacccgttacccccggttccgg

SEQ ID NO: 350743 - DNA, 608 bp, Homo sapiens
  misc_feature: GZ8MTXP02IWSA3.10.27.C05.1.454.CMB.2.raw
  modified_base (252)..(252): a, c, t, g, unknown or other
  misc_feature (252)..(252): n is a, c, g, or t
  modified_base (441)..(441): a, c, t, g, unknown or other
  misc_feature (441)..(441): n is a, c, g, or t
tcagcatagtagtgcacgaccggtgctcgatttagacgcgatcgaagggtttggggagggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatcctcctgcactggacccagcactgatgtggctattataccttntctctgtatcaacaccgccagacaaacgccccccatactcttgtatttatagtagtcagtaacgcgtcctacgtaggggtttctaggtcgtcttctctcgcctcaacgtctggcaacgaccggccctccagtacactctcgtcggctcgacgtctacgacgagacggtctagaacttacttactcgacngtccctagatacttggtaagtgtggttcgttaccgttacttttacggttaaacgggtttccggggtaaagggtaccgggtaaccgacgggtccgtaaccgtacccggttacgtaaaacgttccgaccggtaccccgaagtcccgttacccgcccccggtttaaccgg

SEQ ID NO: 350744 - DNA, 680 bp, Homo sapiens
  misc_feature: GZ8MTXP02F9Q7Y.10.27.C05.1.454.CMB.2.raw
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactcggacccagcactgattggtggctattataaccttgtctcctgtatcaacacgccagacaacnccccanactctgtatttanagaagtcagtaacgccggtccctgtacgggtttctagtcgtcttccctctcgcctaccgaagttccgtacggaccaaaccgacccggtcccttacccctaggtaacctaaacgttccgttccgtcggggtaccctaccgtaacgggccgttaacggaaccggaccggacggtaccgttaagtaaacgttactttaacgcgacgtaagtcctactaagttataggtagttaggttcggttacgtccgtttacgtttacgggttaacgggttttccgggacggggtaaccggtaccggtacggtaccgttaccggaacccgttaccgttaacgaaccgtaccgaccggtaacggtcccgtaccgtcccccgttcggtaccc

SEQ ID NO: 350745 - DNA, 539 bp, Homo sapiens
  misc_feature: GZ8MTXP02IAALK.10.27.C05.1.454.CMB.2.raw
  modified_base (294)..(294): a, c, t, g, unknown or other
  misc_feature (294)..(294): n is a, c, g, or t
  modified_base (363)..(363): a, c, t, g, unknown or other
  misc_feature (363)..(363): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcacccctcctcactcaggacacagggtcctgggccctgtctgccctgactcagcctgcctccgtgtctggtctcctggacagtcggtcaccatctctgcactgacccagcatgatgttggcattataacctgtctctgtatcaacaacgccagacaaacgccccacactctgatttangaagtcagtaagcggcctgagggttctagtcgcttctctgcctcaagtctacggcaacacggcctcccngacaatctctggctcgacgctgacgacgagctagatattactgcagtctcatatgtagatggtactccttctttacgtaaggttttacggcgggtacgggacctagggtctacggacccgttaccgtaacgtcgacgaccccgtaacggtcgtcccggtcccccgttcggtacccg

SEQ ID NO: 350746 - DNA, 667 bp, Homo sapiens
  misc_feature: GZ8MTXP02F44BJ.10.27.C05.1.454.CMB.2.raw
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcacccctcctcactcaggacacagggtcctgggccctgtctgccctgactcagcctgcctccgtgtctgggtcctcctggacagtcgtcaccatctcctgcactcggacccagcactgatgttggctattataccttgtctctgtatacaacaccgccagaccaaaccgccccanactcttnatttanagaagtactagtaacgccggtacctggtacggttctagtccgtcttccctctcgtcctacgtaacgtccgtaggaccaaccgtacccgggtaccctacccccgttagaaacctaacgttccgttccggtaccgggtccctacccggaacggtccgttacgaaaccggacggtgtaccgtaagtaaactacgttacgcgacacgtacttacgtaagttatacggtaagtgttacgggttaccttcctttacggtttaacgttacggggtttacgggacggtacgggtaccgtaggtaccgtacgtaccgtaccgttaaacgcgaaccgtaccggtacgccgtacccggtacccgtcgttacccg

SEQ ID NO: 350747 - DNA, 598 bp, Homo sapiens
  misc_feature: GZ8MTXP02JMBW1.10.27.C05.1.454.CMB.2.raw
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattataacttgtctctgtatcaacacgcccagacaaacgccccacactcttgtatttatgaagtcagtaacgccgccctcgtaggggtttctagtcgtcttcctctgcctcagtctgcaacacggtcctcctagacatctcgtcggcctcccgaggctagaccgacggaggtcgtagaaacttacttacgtgcacgtcctataattagtggttagacgttcgggtcgttccctttcgtttaccgtaacggggtttttccggggacgggtaacgggtaccgagggttccgtcggtaacccgttccgtaaaacgtccgaacgacccgaaacggtccctcccggtacccccgtacggttccc

SEQ ID NO: 350748 - DNA, 655 bp, Homo sapiens
  misc_feature: GZ8MTXP02HD2UG.10.27.C05.1.454.CMB.2.raw
  modified_base (207)..(207): a, c, t, g, unknown or other
  misc_feature (207)..(207): n is a, c, g, or t
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcacntctcctgcactggacccagcactgatggtggctattactaaccttgtctcctgtatcaacacnccagacaaacgccccatctcttgtatttangaagtcaagtacgccgcctgtacgggtttctacgtcgtcttcctctcgcctaccaagtctacggccaaccgtaccggtcccgtacccgttacgaactaaacgttccgttaccgtcgggtccctaccgacgggtccgtacggaccggacggaacggtacgttaacggtaaacttacgttaacgtcggtaacacggtactactagttaagttaggtagtaggttcggtacggtcctttacgtttcggttaacgggttttcggacggggtacgggaccgtacgggtaccgtacggaacccgttcgtaaacgtccgacgacccggtaacgtcccgtcccggtccccgtccgtttacccg

SEQ ID NO: 350749 - DNA, 566 bp, Homo sapiens
  misc_feature: GZ8MTXP02HS5J7.10.27.C05.1.454.CMB.2.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgatgttggctattataacttgtctcctggtatcaacaacgcccagacaaacgccccanactctgatttangaagtnagtagcgcctgtagggtttctagtcgcttcctctcgcctacatctggcaacaccggcctacccngacatctctggctcgagcgtgacgacgagctagtaactattaatcgcagtctacatagtagtagtatggtcgtccttagttacgttagggtttacgggacggttaacgggacctaggtaccgtcgtaacccgttacgtaaaggttccgacggaccccgtaaacggaccgttcccgacccccgtttacggttaaccc

SEQ ID NO: 350750 - DNA, 631 bp, Homo sapiens
  misc_feature: GZ8MTXP02JZX6R.10.27.C05.1.454.CMB.2.raw
  modified_base (384)..(384): a, c, t, g, unknown or other
  misc_feature (384)..(384): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcactctgcagtgtcagtggtccaggcagggctgactcagcccaccctcggtatccaaggacttgagacagaccgccacactcacctgcactgggaacaacaacaatgttggccacgacggagtcgtttggctgcagcagcaccgagggcccacccctcccaagcctcctctcccgacaggaactaaccactcccggccctcgacgggatctcagagagattctctgcatccagtcagagcacacgccctccctanaccctattacgtcggactccgaggctacgaacgacgaacgcctagtaattacttcgtcgacttacgacgacgtacgtacgggggaccctacccggggtaccctacggtaacgggttcgggtaccggggtttcgggggtttaccggggacccggggttaacgggggaacccgtaaacggtcccgtacgggtaaccccggttccggtaacgggtccgaaacccgggcccgaaacgggtccctcccccgg

SEQ ID NO: 350751 - DNA, 604 bp, Homo sapiens
  misc_feature: GZ8MTXP02JFIH2.10.27.C05.1.454.CMB.2.raw
  modified_base (196)..(196): a, c, t, g, unknown or other
  misc_feature (196)..(196): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (453)..(453): a, c, t, g, unknown or other
  misc_feature (453)..(453): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacngtcggtcaccatctcctgcactggacccagccactgattgttggactattactaacttgctctgtatacaacacgccagaaccaactccccanctctgtatttangaactnaagtaacgccggtacctcgagggtttctagtccgtcttccctctcgcctaccaagtccgtcgctaaaccacggcccctaccgtagactaaactccgtacgtcgggccttacgaggtctcgacgacgaggcttagaattacttacgncgagacttagacttagtacgttagtagttacgggttctacccgttgttttaacgaacgggttttcggacgggacgggtacctagggtccgtacgtacccgttacgaacgtcgacgaacccgtacggccgttaccgaccccgtcggttaccc

SEQ ID NO: 350752 - DNA, 647 bp, Homo sapiens
  misc_feature: GZ8MTXP02GUOJX.10.27.C05.1.454.CMB.2.raw
  modified_base (285)..(285): a, c, t, g, unknown or other
  misc_feature (285)..(285): n is a, c, g, or t
tcagcatagtagtgcacgaccggtgctcgatttagacgcgatcgaagggtttggggggggtcacaagaggcagcgctctcgggacgtctccaccatggcctggctctgctgctcctcaccctcctcactcaggacacagggtcctgggccctgtctgccctgactcagcctgcctccgtgtctggtctcctggacagtcgtcacatctctgcacgtcggacccagcactgatggtggctattactacttgtctcctgtactcaacacgccagaccaacgccccanactcttgtattatgaagtcgagtaacgcccggtccgtgtacggggtttactaggtcgtcttccctcgtccgtacctaccgtaagttccgtacgggacctaaccgaccggtcccttacccgtagaactaacttccgtcgtcgggtccctccgaacggtcgtacggaacggacggacggtactagtaacttactttaacgcgtacgacgtacctagtatagtagtagtacgttggtcgttaccgtttacgtttacggtaacgggtttcgggacgggtacggaccgtagggtaccgtacggtaacccgtacgtaacggtaaccgacggtaccgacgtccgtacccgtccccggttacggtacccc

SEQ ID NO: 350753 - DNA, 737 bp, Homo sapiens
  misc_feature: GZ8MTXP02H0GYE.10.27.C05.1.454.CMB.2.raw
  modified_base (298)..(298): a, c, t, g, unknown or other
  misc_feature (298)..(298): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctcgccctgactcagcctgcctccgtgtctggtctcctggacagtcggtcaccatctctgcactcggacccagcactgatggttggctattactacttgtctctgtatcaacacgccagacaacgccccatctcttgtatttangaatcagtaacgccgtcctcgtagggttctagtcgtcttcctctcgtcctactaagtcgtacggcctaaccgaccggtccctacccgtacgaacctaaacttcccgttccgtcggggtcccttacccgaacgggtccgttacggaacccggaacgggtacggtaccgtaagggtaaacttaacgttaaacgttcgccgtaaggtaccttactaaagttagttaggtaacgtaagtttcggtcggtttcccctttacgttttaaacgggtttaccggggttttaccgggggaccggggttaaacggggtacccgtaacgggtaccgttacgggttaacccccgttaacggtttaaaccggtaacccggaacccggttaacccccggaaacgggttcccccgtacccccgggttacccccgttcccggggtttaacccccg

SEQ ID NO: 350754 - DNA, 599 bp, Homo sapiens
  misc_feature: GZ8MTXP02FOLWN.10.27.C05.1.454.CMB.2.raw
  modified_base (377)..(377): a, c, t, g, unknown or other
  misc_feature (377)..(377): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatcctctgcactggaccagcactgatgttggctattatacttgtctctgtatcaacacgccagacaaacgccccacactcttatatttacagtaagtactaagtaacgccggcccttcgtacggggtttctagtcgtctttcctctcgcctaccaagtctagccgaaccnccgggcctccctgaacatcctcgacggctcagctgacgacgaggctagaatacttaactgaccgagtctactaagtacgtagtaaggtgtcggttcgtccctttagtttacgttaagggttttccggggacggggtacgggtaaccgacggtacgtaccggtaccgtaccgtaacggtaacgacggacccgtaacggccgtaccgccccgttcggtaccccg

SEQ ID NO: 350755 - DNA, 591 bp, Homo sapiens
  misc_feature: GZ8MTXP02FZ6C8.10.27.C05.1.454.CMB.2.raw
  modified_base (198)..(198): a, c, t, g, unknown or other
  misc_feature (198)..(198): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
tcagcatagtagtgcacgaccggtgctcgatttagacgcgatcgaagggtttggggggggtcacaagaggcagcgctctcgggacgtctccaccatggcctgggctctgctgctcctaaccctcctcactcaggacacagggtcctgggccctgtctgccctgactcagcctgcctccgtgtctgggtctcctggacngtcggtcaccatctctgcactcggacccagcactgatgtggctattactacttgtctctgtatcaacacgccagacaacnccccacactctnatttanagagtcagtacgcgccctgtagggtttctagtcgtcttctctcgtcctacagtctcggactacgccgtcctctacgacactctcgnggcctaccnggactggaccgacgcggtactacgaattactacgtcgacacgtctactattagtagtaacggtgttcgggtctttaccttcggtttaaccgttagggggttccgggacgggtacggggtaaccgcggtacccgttacggtaccgttaccgtaacgtcgaaccgtaccgacggtaccctcccggtccccgtcgtcctaccg

SEQ ID NO: 350756 - DNA, 575 bp, Homo sapiens
  misc_feature: GZ8MTXP02IL8MY.10.27.C05.1.454.CMB.2.raw
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (296)..(297): a, c, t, g, unknown or other
  misc_feature (296)..(297): n is a, c, g, or t
  modified_base (420)..(420): a, c, t, g, unknown or other
  misc_feature (420)..(420): n is a, c, g, or t
  modified_base (454)..(454): a, c, t, g, unknown or other
  misc_feature (454)..(454): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcatgatgttggctattataaccttgtctctgtatcaacacgccagaacaacnccccanactctgatttnnaagtcagtacgcgcctgtagggtttcagtcgtcttcctctcgccctcacgtctcggcaaccaccggcctccctagaactaattccgtagtcgggcctacgacgctgacgacgaggctagactntactgcacgtctcattagtcgtaagtgttggtcnccgtttcgttacgttaagggtttcggacggtacgggacctaggtcctacgacccgttacctaaggttaaccgaccggacccgtaaacgggcctttacccggcccccgtttacggtaccccg

SEQ ID NO: 350757 - DNA, 631 bp, Homo sapiens
  misc_feature: GZ8MTXP02JK45S.10.27.C05.1.454.CMB.2.raw
  modified_base (273)..(273): a, c, t, g, unknown or other
  misc_feature (273)..(273): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctcctgacagttgtcacatctctgcacgtgaccagcactgatggttggctattactacttgtctccgtagtactcaacacgcccaanacaaccgccccacactctgtatttacgagtaatcgaagtaacgcccggtccttacgtacgggtttctagtcgtccttcctactcgtaccctcgtaagtccgttacggctaaaccgcgtccctacccagtacaaactctccgtggcccttcgacgtctacgaaccgaacgcggttaactagtaaacttacgtttacgtcgacgttacggactaccggtattaagtagtaagtacggtggtaccgtacgtttacgtttacgggttacggtttacgggacgggtacggtaccggacgtaccggtaccgtaccgtctaacgtccgacgtacccgacgtccgtccctccccggtcttaccccg

SEQ ID NO: 350758 - DNA, 749 bp, Homo sapiens
  misc_feature: GZ8MTXP02J3RMU.10.27.C05.1.454.CMB.2.raw
  modified_base (214)..(214): a, c, t, g, unknown or other
  misc_feature (214)..(214): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
tcagcatagtagtgcacgaccggtgctcgatttagacgcgatcgaaggggtttgggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcggtcacctatctccngacactcggacccagcactgatgtgctattactactgtctcgtgtactcaacacgccaagacaaccgccccanactctagtatttanagaatcgaagtaccgccgtccgtagtcgggtttcacggtctcttccctacgttcgcccctacgtaacgtccggttacgccgaaactccccgggtccctacccgtagtaacctaaacgttccctaccggttacgggggtccctaccgggtaacggtacggtacgtacccggggaaacgtacggggttaacctagggttaaaacctttacgtttaaacccgggacgtaccgtaacgtacctaaactaacggtaaaccctaaacccgaaccgtacgtaaccgtacgttaccctttacggttaccggttaacggtttaaccgggtaccggggaaccgggaaccgggtaaaccgtaacccggtaccgttaacccggttacccggttaaccgtaaccgggtaaccgtaacccggtacccggtaccggtccccgttacccccgtcccggttaccg

SEQ ID NO: 350759 - DNA, 564 bp, Homo sapiens
  misc_feature: GZ8MTXP02GTNBV.10.27.C05.1.454.CMB.2.raw
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (426)..(426): a, c, t, g, unknown or other
  misc_feature (426)..(426): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcactcggaccagcactgatgttggctattactaacttgtctcctgtatcaacacgccaacggaacnccccanctctagtatttanagagtcaagtacgccgtcctagtagggttactagtcgtcttcctctcgcctacgaagtctgcaaacgcggcctcctagactatcgtcgtggcctcgaggctcgacgcgtagctagaactattacgngactagctactagtatagtagtagtggtctccttagtttacgttaagggttcggacgggtacggacgtacggtcgtacggaccgtacgttaaggaaccgacgaccggtaacggtcctacccgccccgttaggtacccc

SEQ ID NO: 350760 - DNA, 657 bp, Homo sapiens
  misc_feature: GZ8MTXP02JSNKX.10.27.C05.1.454.CMB.2.raw
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacgagggtcctgggccctgtctgccctgactcagcctgcctccgtgtctggtctccgtggacagtcggtcaccatctcctgcacgtgacccagcactgatgtggctattatactgtctctgtatcaacacgccagacaacnccccanctctgattangaatnagtacgcgtcctgtagggttcagtcgtctcctctcgcctacaagtctcggccaaaccgccggtccctcctagaactactcgtcgtcgggcctccgacggtaccgtcgaacgaccggacggtactaacggtaaattacgtttaaaccggtgtaccgtacgtacctagtaagttaacgttacggtaaggtacggttcggtaccgttacccgtttaccggtttaacgggttaacgggtttaccggggacggggtaaccgggtaccggtacggttaccgttaccggtaacccgttaaccgtaaccggtaaccgtaaccggtacccggtacggtcccgtaccccggtaccccggttaccgtaccg

SEQ ID NO: 350761 - DNA, 571 bp, Homo sapiens
  misc_feature: GZ8MTXP02IJUG2.10.27.C05.1.454.CMB.2.raw
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcacatctcctgcactggacccagcactgattggttggactattactaacttgtctctggtatacaacacgcccaagaccaaacgcccccanactctgtatttanagaatnagtacgcggcctgtagggtttcagtctcttcctctgcctcaagtctgcaacncggcctacctgacaatctctggcctcgagctagacgacggagtntagaaatatactgcagtactactatacgtagtagtagtggtcgtactttcgttacggtacggtttcgggacggtacgggtaccaggtcgtacggtaacccgtacgttaacggtaaccgacggacccgtacgggtaccctacgggtacccctaagtttccccgg

SEQ ID NO: 350762 - DNA, 733 bp, Homo sapiens
  misc_feature: GZ8MTXP02I6JT4.10.27.C05.1.454.CMB.2.raw
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (345)..(345): a, c, t, g, unknown or other
  misc_feature (345)..(345): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcggtcaccatctcctgcactcggacccagcactgatgttggcattataacttgtctctgtatacaacacnccanaccaaacgccccacactctgtatttangaatcagtaacgccggtcctcgtacgggttcttagtcgtcttccctntcgacctccgtagtctcgccaaaccgaccggccctacccgtacgaacctaaacgtcctccgtacgggccttacccggaggccgtacggaccggtaccggaacggtactacggtaaaacttacgtttacgcggacgtaacggtccgttataacgttagttaggttaggtacggtttacggggtaccgtttcccgtttaccgtttaaccgggttttaaaacgggggtttttccgggggaccggggtaaaaccgggggtaccccgttacggggaacccggtttaccgggaaacccccggtttaccggtttaaacggaaccccgttaaaaccggaccccgggttaaaacggtcccttacccccgggttacccccccggttacggttcccccg

SEQ ID NO: 350763 - DNA, 588 bp, Homo sapiens
  misc_feature: GZ8MTXP02GMUM6.10.27.C05.1.454.CMB.2.raw
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (445)..(445): a, c, t, g, unknown or other
  misc_feature (445)..(445): n is a, c, g, or t
tcagcatagtagtgcacgaccggtgctcgatttagacgcgatcgaagggtttggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttatgaagtcagtaagccggccctcgagggtttctagtcgccttctctgtcctcaagtctggacaacacggcctccctgacaatctcgtggcncnggctgacgacgaggctagaatattactgcagctacgattacgtgtaagngtaggtcgtacccttcgtttaccgtaaggggttttccggacggggtaacggggaccgtacgggtcctacggaccccgttaccgtaaacggttaccgaacggaccccgtaaacgggtcccttaacccggccccccgttaccggg

SEQ ID NO: 350764 - DNA, 671 bp, Homo sapiens
  misc_feature: GZ8MTXP02HFL3F.10.27.C05.1.454.CMB.2.raw
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctcgccctgactcagcctgcctccgtgtcgtgggtctctggacagtcgtcaccatctcctgcacgtcgaccagcactgtatggttggactattaactaaccttgtaccttccgtaggtactaccaaacaaccgcccaagaaccaaacgccccatactcttagttactttanagtaagtntaagtacggtcccggtcccttaggtacggggtttcctaggtccgttcttcccgtcctcgtcccctacgtaacgttccgcgggacctaaaccgccggtcccctacccgttagaactaacgttcccgtacgtcggtccctaccgaacggtcgacgacggtacggacgtacgtaagtaacttagttactgacgtaactctctaattagtagtagtagttcgggtacttcccgtttagtttacgttaacggggtttcggacggtacggaacgcgtacgtccgtaaccgtagttaacgcgtaaccgaccgttacggcccgtacccgccccgtttacgtccccg

SEQ ID NO: 350765 - DNA, 606 bp, Homo sapiens
  misc_feature: GZ8MTXP02GLKVM.10.27.C05.1.454.CMB.2.raw
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtcgtgggtctcctggacagtcggtcaccatctcctgcactggacccagcactgatgtggctattataaccttgtctcctggtatacaaacaaccgcccaagacaaacgccccaanactctgatttanagaatcagtaacgccgaccgtcgtagggttctagtcgtcttctcgtcgcctacaagtctacggcctaaaccgccggtccctaccctgaaactactctcgcggcctcgaggctagacgacgagcgtanaatattacgnacgactctactattagtagtagagttcggtactccgttacgtttacgtaacgggttttcggggacgggtacggtaccgacgggtactacgtaacccgtaccgttaaacgtaaccgaccgaacccgaaacggggtccctacccggtcccccgttacggtaccc

SEQ ID NO: 350766 - DNA, 694 bp, Homo sapiens
  misc_feature: GZ8MTXP02F3FTN.10.27.C05.1.454.CMB.2.raw
  modified_base (213)..(213): a, c, t, g, unknown or other
  misc_feature (213)..(213): n is a, c, g, or t
  modified_base (276)..(276): a, c, t, g, unknown or other
  misc_feature (276)..(276): n is a, c, g, or t
  modified_base (352)..(352): a, c, t, g, unknown or other
  misc_feature (352)..(352): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctggtctccgtggacagtcgtcaccatctctncactcggaccagctacgtgagttgtggactaattactacgttgtctctgtacaccaacgaccnccaagaaccaaccgccccatcttcttagtattagtagaactcgaagtaaccgccggtacctggttacgggtttacncgtcgtcttacctctcgtacctacgagtccgcgaccgaccgtacccggtccctaccgtagtaaacctacgtcccgtaccgtacgggtaccctaccggtaaggaccgttacggaaccggttaacccgggaggttaaccgtaaggttaaacttacgttaaccgtagtaaccgtacggtacttacgtaagttagttaggtacgtacgttcggttaccgttccgtttagtttacgggtacggtttacgggacggtaacgggaccgtacggtcgtaccgtaccgttacgacgtccggaaccgtacccggtaacggttccccgaccggtccccgttacgttacccccg

SEQ ID NO: 350767 - DNA, 577 bp, Homo sapiens
  misc_feature: GZ8MTXP02F028Y.10.27.C05.1.454.CMB.2.raw
  modified_base (342)..(342): a, c, t, g, unknown or other
  misc_feature (342)..(342): n is a, c, g, or t
  modified_base (369)..(369): a, c, t, g, unknown or other
  misc_feature (369)..(369): n is a, c, g, or t
  modified_base (476)..(476): a, c, t, g, unknown or other
  misc_feature (476)..(476): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtcgtggtcctccgtggactagttcggtcacctatctcctgcactcgacccagcactgattggtggctattatacttgtctcgtagtacacaacacgccaagaaccaaccgcccctaatcttctgtatttagagactgagtacgccgtcctggttacggttcngtcgtcttcctctcgtcacgtacgtcncgacctaccgccggtcctccagaactctcgtcgtacgtccacgcgcgtagaacgacgtacgtacgtagtaatacttacgcgtactagtctacagttacgtagtacgngttcggtctcgtttacgttacgggtaggttcggacggtcgacgtcgtacgtcgtaccgtacgtacgcgaaccgcgtacgccgtacgtcccgtagttacccg

SEQ ID NO: 350768 - DNA, 632 bp, Homo sapiens
  misc_feature: GZ8MTXP02F00AK.10.27.C05.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatcctcctgccacgtcggacccagcactgatgtggctattactacttgtctctgtatcaacacgccagacaaacgccccanactctgtatttanagatcagtaacgccggcctgtagggtttcagtcgtcttcctactcgacctcaacgtccgtaggccaaaccgaccggtccctacccgtagaacctaacttcccgttacggtcgggtccctaccggacggtacgttacggaaccggaacggtaaggggtacctaaggtaaacttacttaacgtcgacgtacgtctactaagttagtacgttagtacgttcggtcgttccgttacgtttaacggttacgggtttcggacggggtacggacgtacggtcgtaccgtaaccgtcgtaacgcgtaccgaccgtacggctacccgcccgtacgttcc

SEQ ID NO: 350769 - DNA, 674 bp, Homo sapiens
  misc_feature: GZ8MTXP02JR3N4.10.27.C05.1.454.CMB.2.raw
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctcgccctgactcagcctgcctccgtgtcgtggtctccgtggacagtcgtcaccatctctgcaccgtcggaccagcacgtgagttggttggacttattacttacttgtctcgtgtactacaaacaccgccaagaccaaccgccccataccgttcttagtaactttagacgtaagtacgtaaggtaaccgtcccgtccgttacggttagggttacctacgttcgtcttccctcgtaccgtcctacgtacgttcgtcgacctaaccggtccctcccttaccgtataaaccgtacttacccggtccgtccggtcccaaccggttgccgttacgggaccggtacggacgtacgtaattaacgttacttacgcttacgacttcgtaacttgttagtagtaacgtggttacgtccgttactttacggggtttacgtacgggtttacgggcgggaccgtcggtacgtccgtaccgtacccgtatacgccgacggtacccgacgtcccgtcccgaccctcgttacccg

SEQ ID NO: 350770 - DNA, 788 bp, Homo sapiens
  misc_feature: GZ8MTXP02FMLS6.10.27.C05.1.454.CMB.2.raw
  modified_base (765)..(765): a, c, t, g, unknown or other
  misc_feature (765)..(765): n is a, c, g, or t
tcagcatagtagtgcacgaccggtgctcgatttagacgcgatcgaaggggtttggggggggtcacaagaggcagcgctctcgggacgtctccaccatggcctgggctctgctgctcctcacccctcctcactcaggacacagggtcctgggccctgtctgccctgactcagcctgcctccgtgtctggtctccgtggacagtcggtccaccatcctcctgccactcgacccagcactgtagttggttcggactaatttactaacccttgttctcctagtactacaaaccaaccacccaacgaaccaaaccgcccccactacttcttagtaatttacgtagtaagtacaacggtaacggtcccggacccgttcggttaacgggtttctaggttccgtctttcccgtcctctccgtactaacgttcgtacggaccctaaccgacccggtcccttaccccgacgtaaacctaacgttccctcgggttcgggacccttaccgaagggtcctacgggaaaccgtcggggtaacggtacctttaaaggaaaactttacgtttaaacccgtggaccgtaacggtcccttacctttaaaggttaaacttacggggtttaaagtacggtttccggggtttaacttccccggtttttaacgtttaaaaccggggtttaccgggggttttaacgggggccggggtaacggggtaccgtaaacgggtccggtaccgtaacccggtacttaacggcgaccggtaacccgacggttccncccccggtaccgttcccggtacc

SEQ ID NO: 350771 - DNA, 554 bp, Homo sapiens
  misc_feature: GZ8MTXP01AWIO6.15.80.H03.1.454.CMB.2.raw
  modified_base (221)..(221): a, c, t, g, unknown or other
  misc_feature (221)..(221): n is a, c, g, or t
  modified_base (410)..(410): a, c, t, g, unknown or other
  misc_feature (410)..(410): n is a, c, g, or t
tcagtctacgtagccacgaccggtgctcgatttagctgtgcgtcgaagggaaaggggcagggtctccgaaggcttcaccagccctggacctcctgtgcaagaacatgaaacatctgtggttcttccttctcctggtggcagctcccagatgggtcctgacccaggtgcagctgcaggagtcgggcccaggactggtgaagccttcggagaccctgcccctnacctgcactgtctctggtgctccatcagtacttactactggagctggatccggcagcccccagggaagggactggagtggattggggtatatctattacagtggagcaccaactacaaacccctcctacaacgagtcgagtcaccaatgtcagtagacacgtcaagacaagtctcctgagttcgacctntgtgaccgctgcgacacggccgtggtattacgtgtgcgagcgtaggggggggttcgacgtaccgtggggcacgtggggccaggggacgcccgtagtcaccgttccttcccgaagccctcaccacgggcctaacgttcgtccccg

SEQ ID NO: 350772 - DNA, 741 bp, Homo sapiens
  misc_feature: GZ8MTXP01CKBA2.15.80.H03.1.454.CMB.2.raw
  modified_base (223)..(223): a, c, t, g, unknown or other
  misc_feature (223)..(223): n is a, c, g, or t
tcagtctacgtagccacgaccggtgctcgatttagctgtgcgtcgaagggaaaggggcagggtctccgaaggcttcaccagccctggacctcctgtgcaagaacatgaaacatctgtggttcttccttctcctggtggcagctcccagatgggtcctgacccaggtgcagctgcaggagtcgggcccagggactggtgaagccttcggacgaccctgcccctnacctgcactgtctctggtgctccatcagtacttactactggagctggagtccggcacgcccccgaagggaacggacgtggagtggattggggtatatcgtaattacgaggtgggacacgaaccaacctaaccgaaccccctcctacgaaacgtacgtacgacgtccacctaagtcgtcacgtacgaaccaccgtaccaaacggaaaccctaagtcctcccgtaggtacggttctaaccgttcgtagtacgaccgtcgtacgccggacgaccgggtccgttacggtacgtttacgtcggtcggacgtacgggtacggggttacgggggggggttaccggtaccgggtccgggttacggggtaccggacgggtccgggggaccgggttaacggggtacccggttaccggtacggttacccgttacccggttccccgttaccccggaaccccgttaccccgtaaccccggtaacccgggaaccgggaccccgttaacggttccccgggttttcccccccgg

SEQ ID NO: 350773 - DNA, 613 bp, Homo sapiens
  misc_feature: GZ8MTXP01B884F.15.80.H03.1.454.CMB.2.raw
  modified_base (220)..(220): a, c, t, g, unknown or other
  misc_feature (220)..(220): n is a, c, g, or t
  modified_base (321)..(321): a, c, t, g, unknown or other
  misc_feature (321)..(321): n is a, c, g, or t
  modified_base (354)..(354): a, c, t, g, unknown or other
  misc_feature (354)..(354): n is a, c, g, or t
tcagtctacgtagccacgaccggtgctcgatttagctgtgcgtcgaagggaaaggggcagggtctccgaaggcttcaccagccctggacctcctgtgcaagaacatgaaacatctgtggttcttccttctcctggtggcagctcccagatgggtcctgacccaggtgcagctgcaggagtcgggccaggactggtgaagccttcggagaccctgcccctnacctgcactgtctctggtgctccatcagtacttactactggagctggactccggcacgcccccgagggaagggactggagtggattgggtatatctatacngtggagcacaactaccaacccctcctacaacgngtacgagtcaccaatcgtcagtacgacacgtaccaaacgaaccaacgtcctacctaggtacggttcgaccgttctcgtacgaccgtcgtggccgacgacggccgttggtattacgtgtcgcggaggacgggtaggggggggtcgacgtcggtgggcgacggtcggggccgaggggacgccgtacgtccgacccggttccgttccccgaacgccctccgaacccggaccgggttaccctaaccggttcccggttcccccg

SEQ ID NO: 350774 - DNA, 542 bp, Homo sapiens
  misc_feature: GZ8MTXP02F417W.15.80.H03.1.454.CMB.2.raw
  modified_base (264)..(264): a, c, t, g, unknown or other
  misc_feature (264)..(264): n is a, c, g, or t
  modified_base (534)..(534): a, c, t, g, unknown or other
  misc_feature (534)..(534): n is a, c, g, or t
tcagtctacgtagccacgaccggtgctcgatttagctgtgcgtcgaagggaaaggggcagggtctccgaaggcttcaccagccctggacctcctgtgcaagaacatgaaacatctgtggttcttccttctcctggtggcagctcccagatgggtcctgacccaggtgcagctgcaggagtcgggcccaggactggtgaagccttcggagaccctgcccctcacctgcactgtctctggtgctccatcagtacttactactgganctggatccggcagcccccagggaaggactggagtggattggggtatatctattacagtggagcaccaactacaacccctcctcaagagtcgagtcaccatgtcagtagacacgtccaagaaccaagtctaccctgagttgacctctgtgaccgctgacgacacggccgtgtacttactgtgcgagacgtagggggggtcgacgacgtggggcacgtgggccaggggacgccgtagtcaccgtctccccaagcctaccacgaacggcccancggttccc

SEQ ID NO: 350775 - DNA, 591 bp, Homo sapiens
  misc_feature: GZ8MTXP02GBYH2.15.80.H03.1.454.CMB.2.raw
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
  modified_base (347)..(347): a, c, t, g, unknown or other
  misc_feature (347)..(347): n is a, c, g, or t
tcagtctacgtagccacgaccggtgctcgatttagctgtgcgtcgaagggaaaggggcagggtctccgaaggcttcaccagccctggacctcctgtgcaagaacatgaaacatctgtggttcttccttctcctggtggcagctcccagatgggtcctgacccaggtgcagctgcaggagtcgggcccaggactggtgaagccttcggagacccctgcccctcacctgcactgtctctggtgctccatcagtacttactactggagctggatccggcacgcccccagggaaggctggagtggatgggtatagtntatacagtggancacaactaccaacccctccctnaacgagtcgagtccaccatcgtcagtacgacacgtaccaaagaaccagtcctcctgagtcgacctacgtgtcgaccgcgtcgcggtacgaccggtcgtagtacttacgtgtggacggtaaggacggggttaggggggggtcggaacgcggtacggggcgacggtcgggggaccggtaggggcgtccgtacggtccgaccgtcccgtcccgaacgccctacgaccgacggccacgtcggtccccg

SEQ ID NO: 350776 - DNA, 585 bp, Homo sapiens
  misc_feature: GZ8MTXP01BH17W.13.40.D07.1.454.CMB.2.raw
  modified_base (257)..(257): a, c, t, g, unknown or other
  misc_feature (257)..(257): n is a, c, g, or t
  modified_base (315)..(315): a, c, t, g, unknown or other
  misc_feature (315)..(315): n is a, c, g, or t
  modified_base (345)..(345): a, c, t, g, unknown or other
  misc_feature (345)..(345): n is a, c, g, or t
  modified_base (516)..(516): a, c, t, g, unknown or other
  misc_feature (516)..(516): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttggaagcatctctcaaagcgggacaccgactataacccgtntttaggagtcgagtctcgattcaatagacaggtctaagacacaattctccctgaggtnacctctatgtcggccgcggacgcggccgtntattctgtcgcgcgaggactccgtaccgtcggaactcgtttcggagaaccaagggacaaaacgtccgaagtcgttatctacttgactccgtggggccacgggaaccctgtcagcgtcgtcttcacgcctccacccgacgggcccacgtccggtcccttccccgtcggcccnccctccttccaacgcgccgacccttcgttcggggccaacgacggccggcccgtgggcctcgcccgtggg

SEQ ID NO: 350777 - DNA, 654 bp, Homo sapiens
  misc_feature: GZ8MTXP01C2QRY.13.40.D07.1.454.CMB.2.raw
  modified_base (262)..(262): a, c, t, g, unknown or other
  misc_feature (262)..(262): n is a, c, g, or t
  modified_base (355)..(355): a, c, t, g, unknown or other
  misc_feature (355)..(355): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgaggggggggcctgggagtggcgttggaagcatctctcgaaagcgggacgaccgactataacccgtntttaggatcgagtctcgatttcaatagacaggtactaaagacacaattctccctgagggtgacctctatgtcggccgcgggacgcggtccgtntacgttactggtcgcggcgaggtactccgtaacccggttcgaactacgttcgtagaacaagggacaaaaacggtccgaaagttcgttaatacgtactttgacttccgtcggggaccgacggggaaccctggtacacgtccgttctcgttcgacgtccctaccaccgaacggccctaacgtccggttccttcccccgtcggccctaacccctcccttaccgaaacgcgtaccgaaccgttccggttcgggggccaaccgacggcccggtcccgttcggggcctcggttcccgttaacggg

SEQ ID NO: 350778 - DNA, 593 bp, Homo sapiens
  misc_feature: GZ8MTXP01C8XST.13.40.D07.1.454.CMB.2.raw
  modified_base (318)..(318): a, c, t, g, unknown or other
  misc_feature (318)..(318): n is a, c, g, or t
  modified_base (534)..(534): a, c, t, g, unknown or other
  misc_feature (534)..(534): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgaggggggggcctggagtggcttggaagcatctctcaaagcgggacaccgactataacccgtctttaggagtcgagtctcgatttcaatagacaggtctaagacacaattctccctgagggtnacctctatgtcggccgcgggacgcggccgtctattactgtcgcgcgaggtactctcccgtgggaacctcttcgtgacaagggacaaaacgtcgaagtcgttatctactttgactccgtcgggccgacgggaaccctggtcagcgtctctcacgcctccaccgaggcccatccggtcccttccccgtcggcccaaccccgtccttcccaacgcgccnccgttccggcgggggttcccaacgcggtccggcccgtcggggccttcggcccgttcggg

SEQ ID NO: 350779 - DNA, 604 bp, Homo sapiens
  misc_feature: GZ8MTXP01B1S2J.13.40.D07.1.454.CMB.2.raw
  modified_base (353)..(353): a, c, t, g, unknown or other
  misc_feature (353)..(353): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (441)..(441): a, c, t, g, unknown or other
  misc_feature (441)..(441): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttggaagcatctctcaaagcgggacgaccgactataacccgtctttaggatcgagtctcgatttcaatagacaggtctaagacacaattctccctgagggtgacctctatgtcggccgcggacgcggcgtctattacngtcgcgcgagatcgtccgtcgaacncttcgngacaaggcaaaacgtcgagtcgttatcactttgactcgtcgggccgacgggaacccngtcgacgtcgtcgtcttcacgcctccgtacccgacgggccctacgtccggtcccgttcccccgtacgggccctaacccctcccgttaccctaacgaccgtaccgaccgttccgttcgggggccaacgacggcccggcccgtcgggccgtcgccgttaaccggg

SEQ ID NO: 350780 - DNA, 627 bp, Homo sapiens
  misc_feature: GZ8MTXP01D6ZTE.13.40.D07.1.454.CMB.2.raw
  modified_base (257)..(257): a, c, t, g, unknown or other
  misc_feature (257)..(257): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtccgaggggggggcctggagtggcttggaagcatctctcaaagcgggacaccgactataacccgtntttaggagtcgagtctcgattcaatagacaggtctaaagacacaattctccctgaggtgactctatgtcggccgcggacgcggcgtctattacgtgtcgcgacgaggatccgtacccgtacggaactacgttcggtagaacaaaagactaaaaacgggtcccgaaagtcgttaatctaacgtttgaaccttcgtcggggtaccacggggaaccctggtcacgtccgttcgtctttcacgtccctccacccgaacgggccccaacgttccggtcctttccccctcgggtcccaaccccttccttacccgaacgcgacctacccgttcgttcgggggcaacgacgccggcccgtgggcctcggcccgttggg

SEQ ID NO: 350781 - DNA, 595 bp, Homo sapiens
  misc_feature: GZ8MTXP01BXHA4.13.40.D07.1.454.CMB.2.raw
  modified_base (267)..(267): a, c, t, g, unknown or other
  misc_feature (267)..(267): n is a, c, g, or t
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
  modified_base (473)..(473): a, c, t, g, unknown or other
  misc_feature (473)..(473): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccagggtcccggaggggggggcctggagtggcttggaagcatctctacgaaaggcgggaacaccgactaactaacccgttntttaggagtcgagtctgtatttcaaatagacaggtactaaagacacaattctccctggagggtcacctntatggtccggccgcggacgcggcctntatctgtcgcgcgagactcgtaccgtagaactcttcgagacaaggacaaaacgtccgaagttcgtatcacttgacgtcgtgggccacgggacctgtcagtcgtcgtcttcncgcctccaccgaacggcccacgtccgtcccttccccgcgccctaacccctccttaccaacgcgccctaccgttcgcgggggaccaacgcggtcccggcccgtgggcctccggccgtaacggg

SEQ ID NO: 350782 - DNA, 592 bp, Homo sapiens
  misc_feature: GZ8MTXP01A5HM2.13.40.D07.1.454.CMB.2.raw
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (393)..(393): a, c, t, g, unknown or other
  misc_feature (393)..(393): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgaggggggggcctggagtggcttggaagcatctctcaaagcggacgaccgactataacccgtntttaggagtcgagtctcgattcaatagacaggtctaaagacactaattcnccctgagggtnacctctatcgtcggccgcggacgcggccgttctattacgtgtcgcgcgaggctccgtaccgcgaacacttcganacaagacaaacgtcgatcgtatctacttgactcgtgggccacgggacctgtcagcgtcgtcgtcacgcctaccgaccgaacggccctacgtccggttcccttcccccgtcggccctaaccccgtcccttaccgaacgacgacccaccgttccggttcggggccaacgcggtccggcccgtcgggccgtcgccgtaacgg

SEQ ID NO: 350783 - DNA, 611 bp, Homo sapiens
  misc_feature: GZ8MTXP01CDNQ7.13.40.D07.1.454.CMB.2.raw
  modified_base (260)..(260): a, c, t, g, unknown or other
  misc_feature (260)..(260): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgattttccggtgtctccatcaccaatgatgattctaactggaactggctccgccaggtcccgaggggggggcctggagtggcttggaagcatctctcaaagcgggacgaccgactataacccgtntttaggagtcgagtctcgatttcaatagacaggtctaagacacaatctccctgaggtnacctntatgtcggccgcggacgcggcctctattactgtcgcgcgaggactccgtaccgtacggaactacgtttcgtagacgaaagggaccaaaaacgtccgtaaagtcgttaatctactttgacgttccgtcggggaccacgggaaccctggtcagcgttcgtcttcacgccctaccacccgaacgggcccagtccggtcccttccccgtcggccctaacccctcttacccgaacgcgcctaccgttcgttcggggccaacgacggccgcccgtgggcctcggccgtaacggg

SEQ ID NO: 350784 - DNA, 584 bp, Homo sapiens
  misc_feature: GZ8MTXP01E1RRD.13.40.D07.1.454.CMB.2.raw
  modified_base (262)..(262): a, c, t, g, unknown or other
  misc_feature (262)..(262): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (513)..(513): a, c, t, g, unknown or other
  misc_feature (513)..(513): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgaggggggggcctggagtggcttgggaagcatctctacaaaggcgggacgaccgactataacccgtnttttaggagtcgagtctcgtatttcaatagacaggtctaaagacacaattctccctgagggtnacctntatgtccggcgcggacgcggccgtntatctgtcgcgcgaggactccgtccgtacgggaacncttcgngaacgtaaggcaaaacgtccgaagttcgtatctacttcgactcgtcggggaccacgggtaaccgtgtcagcgtctcgttcacgcctccaccgacggccctacgtccgtcctccccngcccaaccctccttaccacgcgccgaccttcggttcggggcaacgcgccggcccgtggccgtcgccgtcgg

SEQ ID NO: 350785 - DNA, 833 bp, Homo sapiens
  misc_feature: GZ8MTXP01DRHIT.13.40.D07.1.454.CMB.2.raw
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgaggggggggcctggagtggcttggaagcatctctacgaaaggcgggacgaccgactataacccgtntttaggagtcgagtctcgatttcaatagacaggtctaagacacaattcncctgaggtnacctntatcgtcggccgcgggacgcggccgttctattactgtcgcgcgaggactcccgtaccggtacggaactcgtttcggtagaaccgtaaaacggggacctaaaaaacgggttcccggtaaacggtttaccgtttaacttaccgttaacgttttacgtaacccgttccccgggttaccggggggaccccggtaaccgggggtaaacccccgttcgggttacccgtaacggtcccggtttaccgtttcccgtttacccgtaccggtaccccttaccccgaaaccccgaaaccgggggtaccccctaaccggttccccgggttcccccgttttaccccccccgtccgggtcccccgttaaccccccttcccccgttaaccccgtaaaccggaacccggaccccgtaaccccgttcccggggttccggggggttacccaacccgggtaacccggggccccggggtcccccggttcggggggttcccttccggggttccccggtttaaccggggg

SEQ ID NO: 350786 - DNA, 585 bp, Homo sapiens
  misc_feature: GZ8MTXP01D9ZR8.13.40.D07.1.454.CMB.2.raw
  modified_base (256)..(256): a, c, t, g, unknown or other
  misc_feature (256)..(256): n is a, c, g, or t
  modified_base (318)..(318): a, c, t, g, unknown or other
  misc_feature (318)..(318): n is a, c, g, or t
  modified_base (362)..(362): a, c, t, g, unknown or other
  misc_feature (362)..(362): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacacgactataacccgtnttttaggagtcgagtctcgatttcaatagacaggtctaagacacaattctcccctgagggtnacctctatgtcggccgcggacgcggccgtctattactgtgccgngaggatccgtaccgtcggaactacgttcgtgacaagggacaaaacgtccgagtcgttatctactttgactccgtggggccacgggacctgtcagcgtcgtcttcacgcctccgaccgacggcccatccggtccttccccgtcggcccaaccctccttccgacgacgcctacccgttcgttcgggggccaacacggccgggcccgtcgggcctcggccgtcggg

SEQ ID NO: 350787 - DNA, 645 bp, Homo sapiens
  misc_feature: GZ8MTXP01A9FDI.13.40.D07.1.454.CMB.2.raw
  modified_base (327)..(327): a, c, t, g, unknown or other
  misc_feature (327)..(327): n is a, c, g, or t
  modified_base (359)..(359): a, c, t, g, unknown or other
  misc_feature (359)..(359): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgattttccggtgtctccatcaccaatgatgattctaactggaactggctccgccagggtcccgaggggggggcctgggagtggcttggaagcatctctcaaagcggacgaccgactataacccgttctttaggagtcgagtctcgtatttcaatagacaggtctaaagacacaacttctaccctggagggtnacctctagtgtcggccgcgggacgccggcctntatacgtgtcgcgcgagtactcgtacccgtcggaactcttcggtagacgaaggaccaaaacgtccgtaagtcgttatcactttcgactccgtcggggaccacgggtaaacctggtcaggtcctcgtcgttccgacgccctccgaccgaacggcccacgttcccggtccccttcccccgtcggtaccctcccccttcccgttacccgaacgaccgcccgtaacccgttccggttcgggggccaaccgacggccgggccccgttggggcctcggttccgttaaccggg

SEQ ID NO: 350788 - DNA, 737 bp, Homo sapiens
  misc_feature: GZ8MTXP01D3SLU.13.40.D07.1.454.CMB.2.raw
  modified_base (234)..(234): a, c, t, g, unknown or other
  misc_feature (234)..(234): n is a, c, g, or t
  modified_base (267)..(267): a, c, t, g, unknown or other
  misc_feature (267)..(267): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccagggtcccgaggggggggcctgggagtggcttggaagcatctctanaaaggcgggaacgaccgactaacgtaacccgtnttttaggagttcgagtctcgatttcaaatagacaggtctaaagacactaacttctccctggacgggtgaccttctagtcgtccggccgcgggacgcggtccgttctattactgtcgcgcgaggtactccgtacccggttacggaactcgtttacggtagaacaaacgggacctaaaaaacgggttccgtaaacgttacgtttaattaccgtaacgtttacgtaaccgttcccggttacgggggacccgtaacgggggtaaccccgttacgggttaccgaacggtccggttcgttccctttaccgaccgtacccctaccccgaacccgaaccgggtccccgtaacgttcccggtcccgttcccccgttacggcccctaaccccttcccttacccgtaacgaccggtccacccgttccggttcgggggaccaacggacggtccggcccggtgggccctcggccgttaacggg

SEQ ID NO: 350789 - DNA, 710 bp, Homo sapiens
  misc_feature: GZ8MTXP01A4VIT.13.40.D07.1.454.CMB.2.raw
  modified_base (264)..(264): a, c, t, g, unknown or other
  misc_feature (264)..(264): n is a, c, g, or t
  modified_base (332)..(332): a, c, t, g, unknown or other
  misc_feature (332)..(332): n is a, c, g, or t
  modified_base (388)..(388): a, c, t, g, unknown or other
  misc_feature (388)..(388): n is a, c, g, or t
  modified_base (451)..(451): a, c, t, g, unknown or other
  misc_feature (451)..(451): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttggaagcatctctacgaaaggcggaacgaccgactaacgtaacccgtnttttaggagtcgagtctcgatttcaatagacaggtactaaagacaactaattcctcccgtggacggtnacctctacgtgtccggccgccggacgccggtccgttcgtattacgtggtcgccggngaggactccgtaccgtcgggaactccgttgagaccgaaggacaaaacgtccgtaagtcgttanctacgtttgaccgtacgtcggggaccgacgggtaacccgtgggtactacgtcgttaccgtcgttccgaccgtccctacccgacccgaacgggccctaaccgtcccggttaccccttcccccgtccggtccctaacccccgttccttacccggtaaaccgaccggtcccgtaaccccgttcgggttccgggggacccgaacccgtcccggggcccggtcccccgggtcggggttccgttcccggaaccggtttcccgggg

SEQ ID NO: 350790 - DNA, 612 bp, Homo sapiens
  misc_feature: GZ8MTXP01CA1QT.13.40.D07.1.454.CMB.2.raw
  modified_base (259)..(259): a, c, t, g, unknown or other
  misc_feature (259)..(259): n is a, c, g, or t
  modified_base (326)..(326): a, c, t, g, unknown or other
  misc_feature (326)..(326): n is a, c, g, or t
  modified_base (353)..(353): a, c, t, g, unknown or other
  misc_feature (353)..(353): n is a, c, g, or t
  modified_base (550)..(550): a, c, t, g, unknown or other
  misc_feature (550)..(550): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttgggaagcatctctcaaagcgggacgaccgactataacccgtntttaggagtcgagtctgatttcaaatgacaggtactaagacacaacttctcccgtgagggtcacctntagtcgtcggccgcggacgcggccgtntatactggtcgcggcgaggactcctacccggtcgaactacgttcggtagacaaagggactaaaacggtcccgtaagttcgttaactcgtactttgacgttaccgtcgggggtaccacgggacccgtggtacgtagccgttcgtcttcgacgtcctaccgaaccgacgggcccacgtccgttcctccccgtcggcccnccctccgttccaacgcgacgccttcgttcggggcaacgcgtcggccgtcggctcgccgtcgg

SEQ ID NO: 350791 - DNA, 691 bp, Homo sapiens
  misc_feature: GZ8MTXP01D3K28.13.40.D07.1.454.CMB.2.raw
  modified_base (262)..(262): a, c, t, g, unknown or other
  misc_feature (262)..(262): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgaggggggggcctggagtggcttggaagcatctctacaaaggcgggacgaccgactactaacccgtntttaggagtcgagtctgatttcaatagacaggtactaaagacaactaacttctccccgtaggacggggtcaccttcgtagtcggtaccgggcccggccgggacggccggtccgttctagttactggtcgcggcgaggactccgtaccgtacggaactcgttcggacgacaagaacaaacgtccgtaagtacttagtctacgtttgaccgttaccggtcggggccgaacgggtaacccgtgtacgtacgtccgtccgttccttcgaccgccgtacccgaacccgaaccggtaccctaccgtcccgttacccttcccccgtcggtcccctaaccccttcccgttaccgaaacgttccgacccgtaccgttccggttcggggacctaacggccggtccggcccggtcgggttccgtcggttccgttaacggg

SEQ ID NO: 350792 - DNA, 710 bp, Homo sapiens
  misc_feature: GZ8MTXP01AGW71.13.40.D07.1.454.CMB.2.raw
  modified_base (258)..(258): a, c, t, g, unknown or other
  misc_feature (258)..(258): n is a, c, g, or t
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttggaagcatctctcaaagcgggacgaccgactataacccgtntttaggatcgagtctcgatttcaatagacaggtctaaagacacaattcnccctgagggtgacctntatcgtcggccgcggacgcggccgtctattactggtcgcgcgaggtactcgtacccggtcgggaacctctttccggagtaaccgaaagggtactaaaaaaccgggtccccgtaaagttaccgttaaattccgtaaaccttttcggtaaccgttcccggtacgggggtaccccgaacgggggtaaaccccgttggggtaccgaacggtccggttccgttctttaccgccgtcccgttaccccaacccgaaacgggccccaaccgttcccgggtccccttcccccgttcgggcccctaacccccgttccttacccgaaacgacggcctaacgttccgttcggttcgggggcacgaacggtccgggtccggttcgggccgttggtcccgg

SEQ ID NO: 350793 - DNA, 783 bp, Homo sapiens
  misc_feature: GZ8MTXP01EABL3.13.40.D07.1.454.CMB.2.raw
  modified_base (271)..(271): a, c, t, g, unknown or other
  misc_feature (271)..(271): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgtatttccggtgtctccatcaccaatgatgattctaactggaactggctccgccgacgggtcccggaggggggggcctgggagtggcgttaggaagcatctctacgaaaggcgggacaccgactactaacccgttntttaggagtcgagtctacgtattacaatagacaaggtactaaagactactaacttcctacccgtaggtacgggtcaaccttcgtaagtcggtccgggccggccgggtacggccggtaccgttacttacgttacgtggtcgccggtacggacggtctcccggtaacccgggtacggtaacctacggtttcgacgaaacgtaaacgggaccgtaaaaacggttccggtaaagttacgttaacgtccgttaacgtttacgaccgttaccggtcgggggacccgtaacgggaacccgttggtacacggtcgttcttccgttacgacctacccgtacccgaaccgaaccgggtcccacgttccccggttccccttcccccgtacggtcccctaaccccgttacccgttacccgaaacggttccgtacccgtcccggttaccggggttccggggacccgtaaccggaccggggtcccggtccccgggttcggggcccttcgggttcccggttaacggg

SEQ ID NO: 350794 - DNA, 547 bp, Homo sapiens
  misc_feature: GZ8MTXP02HBJCY.13.40.D07.1.454.CMB.2.raw
  modified_base (347)..(347): a, c, t, g, unknown or other
  misc_feature (347)..(347): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
tcagtcacgtactacacgaccggtgctcgatttagtgatagagcgtaacaacagagggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtctttaggagtcgagtctcgatttcaatagacaggtctaagacacaattctccctgagggtgacctctatgtcggccgcgggacgcggccgtntattactgtcgcgcgaggatctccgtcggacncttcgngaccaagacaaaacgtccgaagtcgtatcacttgactcctggggccacgggaaccctggtcagcgtctcttcagcctccaccaaggcccatcggtcttcccctggccaccctcctccacgacgcacctctcgggggcaacgacgccggcctggctcgctcgg

SEQ ID NO: 350795 - DNA, 549 bp, Homo sapiens
  misc_feature: GZ8MTXP02IYEDH.13.40.D07.1.454.CMB.2.raw
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggcctggagtggcttggaagcatctctcaaagcgggacgaccgactataacccgtntttaggagtcgagtctcgatttcaatagacaggtctaaagacacaattcnccctgaggggtnacctctatgtcggccgcgggacgcggccgtctattactgtcgcgcgaggatcnccgtggacncttcgngacaaggcaaaacgtcgaagtcgtatcacttgactctgggcacgggaaccctgtcagcgtctcttcagcctccaccacgggccactcggtcttcccctcgccaccctcctccaacgacgccacctcgtcgggggcaacgacgcggccgtcggcctcgcctcgg

SEQ ID NO: 350796 - DNA, 571 bp, Homo sapiens
  misc_feature: GZ8MTXP02H9N05.13.40.D07.1.454.CMB.2.raw
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (353)..(353): a, c, t, g, unknown or other
  misc_feature (353)..(353): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtctttaggagtcgagtctcgatttcaatagacaggtctaaagcacaattccncctgaggtnacctctatgtcggccgcggacgcggccgtctattacngtcgcgcgagctctccgtcggacacgtttcgagacaaggcaaaaacgtccgaagtcgtatctactttgactccgtggggccacgggaccctggtcagcgttctcttcagcctccaccgaacggcccacgtcgtcccttccccgtcgcccaccctcctccaacgtacgccaccgtcgtcggggaccaacgacgccggcccgtcgggcctcgcccgtcgg

SEQ ID NO: 350797 - DNA, 583 bp, Homo sapiens
  misc_feature: GZ8MTXP02IDAJF.13.40.D07.1.454.CMB.2.raw
  modified_base (349)..(349): a, c, t, g, unknown or other
  misc_feature (349)..(349): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtctttaggagtcgagtctcgattcaatagacaggtctaagacacaattctccctgagggtgacctctatgtcggccgcggagcccccccccggngtctatactgtcgcgcgagatctccgtcgacacttcgtgacaaggacaaaacgtaccgaagtcgtatctactttgacttcgtggggaccacgggaccctggtcagcgtcttcttcacgtcctaccaccgaacgggcccacgtccggtccttccccgtcgccctaccctcctaccaaacgacgcctaccgtcgtcggggccaacgacggccggtcccgtcgggcctcgaccgtgg

SEQ ID NO: 350798 - DNA, 579 bp, Homo sapiens
  misc_feature: GZ8MTXP02FI7Z2.13.40.D07.1.454.CMB.2.raw
  modified_base (321)..(321): a, c, t, g, unknown or other
  misc_feature (321)..(321): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgattttccggtgtctccatcaccaatgatgattctaaactggaactggctccgccaggtcccgagggggggcctggagtggcttggaagcatctctcaaagcgggacgaccgactataacccgtcttttaggagtcgagtctcgatttcaatagacaggtctaagacacaattctccctgagggtnacctctatgtcggccgcggacgcggcgtctattactgtcgcgcgaggatctccgtcggacacttcgtagacaaggcaaaacgtccgaagtcgttatcactttgactccgtgggccagggaaccctggtcagcgtctcttcacgcctccacccgaacgggcccacgtccggtccttcccccgtggccctaccctccctccaacgacgccacccgtcgtcgggggccaacgacgccggcccgtcgggctcgccgtacggg

SEQ ID NO: 350799 - DNA, 695 bp, Homo sapiens
  misc_feature: GZ8MTXP02JRX3O.13.40.D07.1.454.CMB.2.raw
  modified_base (331)..(331): a, c, t, g, unknown or other
  misc_feature (331)..(331): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtctttaggagtcgagtctcgatttcaatagacaggttactaagacaactattcctccgtaggtagggtcgtacctnttagtcggtccggccggacgggaccggccggtccgttattacttacgtgtccgcgacggagtactccgtccggtacgactcgttcgtacgaacgaagaacgtaaacgtacgtaacgttacgttactacttacgttacgtacccgtcggtccggggaccggaaccgggtaaccgttcggtacgtacggtccggttcttccgttaccgaccgtcccgtacccaacccggaaccggacccgtaccgtccgttccccgttccccgtccggaccctacccctccctacccgaacgaccgaccgtaccgttccggtccgggaccgaacgaccggcccggtccggtcggccgggggtcctccggttccggg

SEQ ID NO: 350800 - DNA, 592 bp, Homo sapiens
  misc_feature: GZ8MTXP02HHTCO.13.40.D07.1.454.CMB.2.raw
  modified_base (266)..(266): a, c, t, g, unknown or other
  misc_feature (266)..(266): n is a, c, g, or t
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (427)..(427): a, c, t, g, unknown or other
  misc_feature (427)..(427): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgattttccggtgtctccatcaccaatgatgattctaactggaactggctccgccagggtcccgaggggggggcctgggagtggcttgggaagcatctctacgaaagcgggacgaccgactactaacccgtntttaggagtcgagtctcgatttcaatagacaggtctaagacacaattctccctgagggtnacctctatggtcggccgcggacgcggccgtntatctgcgcgtgnggatctccgcggactacttcgngaccaaggacaaaacgtcgaagtcgtatctacttnactccgtcggggccgacgggaacccgtgtcgacgtcgtctcttcacgtcctaccaccgaacggcccacgtccggtcccttcccccgtcggccctacccctcccgtccaaccgacgaccaccgtccgtcgggggccaacgcgccggcccgtcggcctcgccgtcgg

SEQ ID NO: 350801 - DNA, 554 bp, Homo sapiens
  misc_feature: GZ8MTXP02JUCZO.13.40.D07.1.454.CMB.2.raw
  modified_base (258)..(258): a, c, t, g, unknown or other
  misc_feature (258)..(258): n is a, c, g, or t
  modified_base (318)..(318): a, c, t, g, unknown or other
  misc_feature (318)..(318): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtgggcttggaagcatctctcaaagcgggacgaccgactataacccgtntttaggagtcgagtctcgatttcaatagacaggtctaagacacaattctccctgagggtnacctctatggtcggccgcgggacgcggccgtctattactgtcgcgcgaggactctccgtggacacttcgtgacaaggcaaaacgtcgagtcgtatcacttgctctgggccgacggacccgtgtcagcgtctcttcacgcctcaccgacggcccactcgtccttccccgcgcctaccctcctaccgacgacgccaccgtcgtcggggccaacgacgccggccgtcggctcgcgtcgg

SEQ ID NO: 350802 - DNA, 577 bp, Homo sapiens
  misc_feature: GZ8MTXP02HPFP0.13.40.D07.1.454.CMB.2.raw
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttggaagcatctctacaaagcgggacgaccgactataacccgtnttttaggagtcgagtctcgattcaatagacagtctaagacacaattctcctgaggtnacctctatgtcggccgcggacgcggcgtctatactgtcgcgcgaggatcgtccgtcggactacttcgtagacaaaggacaaaaacgtccgaaagtcgtatcacttcgacgtcgtcggggcacgggaaccctggtcagcgtctcttcacgcctccaaccgaacgggccaacgtccggtcccttcccccgcggccctaccctccctccaaacgcgaccacctcgtcggggccaacgacgccggtcccgcggcctcgccgtcgg

SEQ ID NO: 350803 - DNA, 575 bp, Homo sapiens
  misc_feature: GZ8MTXP02HULDL.13.40.D07.1.454.CMB.2.raw
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (409)..(409): a, c, t, g, unknown or other
  misc_feature (409)..(409): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctgggagtggcttggaagcatctctcaaaggcgggacgaccgactataacccgtcttttaggagtcgagtctcgattcaatagacaggtctaagacacaattctcctgagggtnacctntatgtcggccgcggacgcggcctctattctgtcgcgcgagatctccgtgacncttcgnacaagacaaaacgtcgaagtcgttatnacttgactcgtcggggcagggaccctggtcagcgtctcttcacgcctaccaccgaacgggcccacgtccggtccttcccccgtcggccctaccccgtcccttacccaacgacgcctacccgtcgtcgggggcaacgacgccggcccgtgggcctcggtccgtcggg

SEQ ID NO: 350804 - DNA, 589 bp, Homo sapiens
  misc_feature: GZ8MTXP02IM22P.13.40.D07.1.454.CMB.2.raw
  modified_base (328)..(328): a, c, t, g, unknown or other
  misc_feature (328)..(328): n is a, c, g, or t
  modified_base (516)..(516): a, c, t, g, unknown or other
  misc_feature (516)..(516): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctgggagtggcttgggaagcatctctcaaaggcgggacgaccgactataacccgtctttaggagtcgagtctcgatttcaaatagacaggtctaaagacacaattctccctgagggtgacctntatgtcggccgcgggacgcggccgtctattacgtgtcgcgcgaggatcgtccgtcggactactttcgagacaaagggcaaaaacgtccgaagtcgtatctacttgactccgtggggccagggaccctggtcagcgttctcttcgacgtcctcccaccgtaacggccccagtccggtcccttcccccgnggccctaccctcctaccaacgacgccaccgtcgtggggccaacgcggccggcccgtgggcctcggcctacggg

SEQ ID NO: 350805 - DNA, 575 bp, Homo sapiens
  misc_feature: GZ8MTXP02JE4UK.13.40.D07.1.454.CMB.2.raw
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
  modified_base (377)..(377): a, c, t, g, unknown or other
  misc_feature (377)..(377): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaacctctccctcaattgcgtgattttccggtgtctccatcaccaatgatgattctaactggaactggctccgccaggtcccgagggggggcctggagtggcttggaagcatctctcaaagcgggacgaccgactataacccgtntttaggagtcgagtctcgattcaatagacaggtctaagacacaattctcctgaggtnacctctatgtcggccgcggacgcggccgtctattactgtcgcgcgagactctccgtcgacncttcgtgacaaggcaaaacgtcgaaagtcgtatctacttgactccgtcggggccacgggacctggtcagcgtctcttcacgcctaccaccgacggcccacgtccggtccttcccccgcggccctaccccgtcctacccaacgacgcctaccgtcggtcggggccaacgacggcccggcccgtgggcctcggccgtcgg

SEQ ID NO: 350806 - DNA, 657 bp, Homo sapiens
  misc_feature: GZ8MTXP02JQA2Y.13.40.D07.1.454.CMB.2.raw
  modified_base (259)..(259): a, c, t, g, unknown or other
  misc_feature (259)..(259): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgattttccggtgtctccatcaccaatgatgattctaactggaactggctccgccaggtcccgagggggggcctggagtggcttggaagcatctctcaaagcgggacgaccgactataacccgtntttaggagtcgagtctcgatttcaatagacaggtctaagacacaattcncctgaggtnacctctagtcgtcggccgcggacgcggcgtctatactgtgcgcgaggtactcgtccgtcggactcttcgtagacgaagggacaaaacgtccgaaagtcgttatctacttgactccgtggggaccaacgggtacctggacacgtccgtctcttcgacgtccctacccaaccgaacgggcccctagttcccggtccctttccccccgtacgggtacccctacccccgtacccgttaccccgaaacggtaccgacccgtaaccccgttccggtacgggggacccaaccggaaccgggcccggggcccccgttcgggggcccgttccgggcccgtttaccgggg

SEQ ID NO: 350807 - DNA, 702 bp, Homo sapiens
  misc_feature: GZ8MTXP02G130D.13.40.D07.1.454.CMB.2.raw
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
  modified_base (322)..(322): a, c, t, g, unknown or other
  misc_feature (322)..(322): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcgttggaagcatctctacgaaaggcgggacgaccgactactaacccgttntttaggagtcgagtctcgattcaatagacaggtctaagacanaattctcctgagggtnacctctatggtcggccgcgggacgcggtccgtctattacgtgtcgcgtcgaggtactccgtaccggtcggacctacgttcggtacgaacaaaggggaccaaaaacggttcgaaacgtcgttaactctacgttagaccgtccgtcggggaccaacggggtaaccctggtccgaaggccgttctcgtttaccgcggtaccctacccgaaccgtaacggggcccctacgttcccgggttcccctttcccccgtcgggtacccctacccccgttaccccgttacccgaaaacggccgtacccgtaacccgtccggttccgggggaccaacccggtaacggccccggggtcccgttcggggccctccgggtcccgttaaccgggg

SEQ ID NO: 350808 - DNA, 592 bp, Homo sapiens
  misc_feature: GZ8MTXP02G9N3Q.13.40.D07.1.454.CMB.2.raw
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (382)..(382): a, c, t, g, unknown or other
  misc_feature (382)..(382): n is a, c, g, or t
tcagtcacgtactacacgaccggtgctcgatttagtgatagagcgtaacaacagagggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttggaagcatctctcaaagcggacgaccgactataacccgtctttaggagtcgagtctcgatttcaatagacaggtctaagacacaattcncctgaggtnacctntatgtcggccgcggacgcggccgtctatactgtcgcgcgaggatcgtccgtcggactcttcgngaccaagggccaaaacggtccgaagtcgttatctactttgactcgtcggggccacgggaaccctgtcgacgcgtctcttcacgtccctaccaccgacgggccctacgtcccggtcccttcccccgtacgtccctacccctcccgtaccaacgacgcctacccgtcggtacggggaccaaccgacgcccggccgtcggcctcgccgtacgg

SEQ ID NO: 350809 - DNA, 567 bp, Homo sapiens
  misc_feature: GZ8MTXP02HE1Z9.13.40.D07.1.454.CMB.2.raw
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtccgagggggggcctggagtggcttggaagcatctctcaaagcgggacgaccgactataacccgtctttaggagtcgagtctcgatttcaatagacaggtctaagacacaattctcctgaggtnacctntatcgtcggccgcggacgcggccgtctatactgtcgcgcgagactcgtccgtcggactcgttcgagaacaagaacaaaacgtcgaagttcgttactctacttcgactcgtcgggcacgggtaacctgcagcgtctctacacgcctaccaccgacgggcccacgtccgtccttccccgcggccctaccctcctaccgaacgtcgccaccgtcgtcggggacaacgacgcggccgtcggcgcgcgtcgg

SEQ ID NO: 350810 - DNA, 659 bp, Homo sapiens
  misc_feature: GZ8MTXP02GYI3K.13.40.D07.1.454.CMB.2.raw
  modified_base (311)..(311): a, c, t, g, unknown or other
  misc_feature (311)..(311): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctgggagtggcttggaagcatctctcaaagcgggacgaccgactactaacccgttcttttaggagtcgagtctcgtatttcaatagacaggtctaagacacattcnccgtgagggtgacctctatggtacggccgcggacgcggcccgtgtattactgtacgcgtcgaggactccgtccgtacggaacctcgttcgtacgaactaagggaccaaaacgtccgaaagtcgttaatctactttgactccgtggggacctacggggtaaccctgggtcacggtcgtactcttacgacgtcccacccgacccgaacggccctaacgttccggtcccgttcccccgtggacccctaccccgtaccccgtccctaaacggaccggtacccaccgttccggcgggggaccaacccggacggcccgggcccccggttggggcccttacggcccgttaacggg

SEQ ID NO: 350811 - DNA, 725 bp, Homo sapiens
  misc_feature: GZ8MTXP02JDEF5.13.40.D07.1.454.CMB.2.raw
  modified_base (255)..(255): a, c, t, g, unknown or other
  misc_feature (255)..(255): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgaggggggcctggagtggcgttggaagcatctctcaaagcggacgaccgactataccgtntttaggagtcgagtctcgattcaatagacaggtctaaagacacaacttctcccgtgaggtcgactcgtatcgtcggccgacggaccggtcggccctacgttattacgtgtcgcgcgaggtactccgtaccgtacgggtaccacgttcgtacgaaccgaagtaaccgaaaacgttccgaaagttccgttaagtacctacgttttacgacccgttcgtacggggacctacgggggtaaaccccttgggaaccctagtccggtacttacccgttacgacccggtaccctacccgaacccggtaacgggtcccctaagttcccgggtttacccctacccccgttggacccctaacccccgtttaccgacgaaaacccggacgtaccctacccggttaaccgggttccgggggacctaaccggaccggttccccgggacccgttccgggggccttacggggtcctttaaccgggg

SEQ ID NO: 350812 - DNA, 781 bp, Homo sapiens
  misc_feature: GZ8MTXP02F6WCN.13.40.D07.1.454.CMB.2.raw
  modified_base (261)..(261): a, c, t, g, unknown or other
  misc_feature (261)..(261): n is a, c, g, or t
  modified_base (322)..(322): a, c, t, g, unknown or other
  misc_feature (322)..(322): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccagggtcccgaggggggggcctggagtggcttggaagcatctctcaaaggcgggacgaccgactataacccgtntttaggagtcgagtctcgatttcaatagacaggtctaagacactaattcctcctgagggtnacctctagtgtccggccgcgggaccgccgggccgttctaagttaccgtggtcgcgcgagggacttcccgtccggtacgggaacctcgtttacggtagaaaccgtaaacgggaacctaaaaaaccgggtcccgtaaacgttaccgttaactaccttacgttttacgtaaccgttcccggtcgggggacccgtaacgggggtaaaccccgttcgggtaccgtaacggtccggttccgttaccgttccgtaaccgtccccgttaccccgaaaccccgaaccggggtcccccgtaacgttcccgggtttcccctttccccccgtcggtaccccctaacccccgtccccgttacccgaaaccggtaccggccccgtaacccgttcccgggtccggggggtacccaacccgggaccgggcccgggtcccccggtcggggtcccgttcggtaccccgtttacgggg

SEQ ID NO: 350813 - DNA, 629 bp, Homo sapiens
  misc_feature: GZ8MTXP02IAXNY.13.40.D07.1.454.CMB.2.raw
  modified_base (262)..(262): a, c, t, g, unknown or other
  misc_feature (262)..(262): n is a, c, g, or t
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
tcagtcacgtactacacgaccggtgctcgatttagtgatagagcgtaacaacagaggggtcctgtcccaagtgcaactacaacagtcgggcccaggactgctgaagcctgcacagacccctctccctcaattgcgtgatttccggtgtctccatcaccaatgatgattctaactggaactggctccgccagggtcccgaggggggggcctgggagtgggcttggaagcatctctcaaagcggacgaccgactataacccgtntttaggagtcgagtctcgatttcaatagacaggtctaagacacaatctcctgnggtgacctctatgtcggccgnggacgcggccgtntatactgtcgcgcgaggntcgtaccgtcggactcttcgagacaggacaaacgtcgaagttcgtatcactttnacgtccgnggggccagggaaccctggtcaggtcgtctacgttcacgccctaccgaccgacgggcccctacgtccggtccccttcccccgtcggacccctaaccccgttcccacccaaacggaccgacccgttaacccgtccgggttcgggggacccaaccggccggacccggggtcccgtccggggcctttcggacccgttaaccggg

SEQ ID NO: 350814 - DNA, 634 bp, Homo sapiens
  misc_feature: GZ8MTXP02H0QAF.13.40.D07.1.454.CMB.2.raw
  modified_base (264)..(264): a, c, t, g, unknown or other
  misc_feature (264)..(264): n is a, c, g, or t
  modified_base (586)..(586): a, c, t, g, unknown or other
  misc_feature (586)..(586): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgattttccggtgtctccatcaccaatgatgattctaactggaactggctccgccaggtcccgagggggggcctggagtggcttgggaagcatctctacaaaggcgggaccgacgactactaacccgttntttaggagtcgagtctcgtattcaatagacaggtactaaagacactaacttcctcccgtggagggtctacctcgtagtcggtcggccggcggacggccggcctctatacgtgtcgcgcgagctcgtccgacgactacttcgacgaacgaaggaccaaaaacggtccgtaaagttcgttaatactacgtttcgaacccgttcggtacggggaccgtaacgggacccgttggcgacggtcctcttcgttcaccggtccctaccgaccgacggccctacgtccgtcccttccccgcgccctacccgtcctaaccgacgcgacccnccgtcgtcggggccaacggcggccggtcctagggcctcggccgtacgg

SEQ ID NO: 350815 - DNA, 671 bp, Homo sapiens
  misc_feature: GZ8MTXP02I2TS4.13.40.D07.1.454.CMB.2.raw
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttggaagcatctctacgaaagcgggacaccgactactaaccgtcgtttaggagtcgtagtctcgtattcaatacgacaggtactaaagacaactaacttcctcccgtggacgggtctacctcgtacgtcggtaccgggccggtaccgggacggccgggtccgttacttaacgttaccgtggtccgccggacgtaggtactccgtcccggtacggacctcgttacgagaacctaacgaaccgtaaaacgttccgaaagttcgttaatccgtactttcgaccgtcgtcggggcctaacgggaaccctggtcacggtccgttcctcttcgcgtcctaccgaaccgacggccctagtcccgttccctccccgtcgacccctaccctctaaccgacgtaccgtccaccgtcgggtcgggaccaacggtccggccggtccgtcgggcctcggtacccgtagg

SEQ ID NO: 350816 - DNA, 545 bp, Homo sapiens
  misc_feature: GZ8MTXP02F0B5N.13.40.D07.1.454.CMB.2.raw
  modified_base (189)..(189): a, c, t, g, unknown or other
  misc_feature (189)..(189): n is a, c, g, or t
  modified_base (262)..(262): a, c, t, g, unknown or other
  misc_feature (262)..(262): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (386)..(386): a, c, t, g, unknown or other
  misc_feature (386)..(386): n is a, c, g, or t
  modified_base (439)..(439): a, c, t, g, unknown or other
  misc_feature (439)..(439): n is a, c, g, or t
  modified_base (471)..(471): a, c, t, g, unknown or other
  misc_feature (471)..(471): n is a, c, g, or t
  modified_base (484)..(484): a, c, t, g, unknown or other
  misc_feature (484)..(484): n is a, c, g, or t
  modified_base (498)..(498): a, c, t, g, unknown or other
  misc_feature (498)..(498): n is a, c, g, or t
  modified_base (511)..(511): a, c, t, g, unknown or other
  misc_feature (511)..(511): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccnggtaaaacccgggggggggcctggagtggcttggaagcatctctcaaaggcgggacaccgactataacccgtntttaggagtcgagtctcgatttcaatagacaggtctaaagacacaattcnccctgagggtnacctctatgtcggcgcggacgcggccgtctattactgtcgcgcgaggatcgtccgttcggacncttcgtgaaccaagggcaaaaacgtccgaaatcgttaatcactttgacttcgngggcagggaaccctggtcagcgtctcttcacncaccacgacgacnctcgtctcctcgcncctcctacacacncacctcgcggcgaacgcgcgccgcgcgcgcgtcg

SEQ ID NO: 350817 - DNA, 619 bp, Homo sapiens
  misc_feature: GZ8MTXP02JEAG0.13.40.D07.1.454.CMB.2.raw
  modified_base (261)..(261): a, c, t, g, unknown or other
  misc_feature (261)..(261): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
  modified_base (391)..(391): a, c, t, g, unknown or other
  misc_feature (391)..(391): n is a, c, g, or t
tcagtcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttggaagcatctctacgaaaggcgggacgacgactactaaccgttntttaggagtcgagtctcgtattcaatagacaggtctaaagacactaatcctccngagggtcacctntatggtccggcgcggacgcggcctctattcgtgtcgcgcgagtctcgtcgtacggactcgttgngaacgaaggacaaaacgtcgaagtcgtatctattcgacgtcgcgggaccgacgggtacctggtctacgtcgttctcttccgacgtccctaccgaccgaccggtaccctacgtcccggttcccttcccccgtacggcccctaccccgtcccacccgtaaacgccgaccgtacccgtcggtacggggaccaacggccggtcccggcccggtcggcctacggccgtacggg

SEQ ID NO: 350818 - DNA, 604 bp, Homo sapiens
  misc_feature: GZ8MTXP01EWKBG.39.87.H10.1.454.CMB.2.raw
  modified_base (263)..(263): a, c, t, g, unknown or other
  misc_feature (263)..(263): n is a, c, g, or t
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
  modified_base (556)..(556): a, c, t, g, unknown or other
  misc_feature (556)..(556): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcacccctnaccgacgtctatatcgcctacgtgttcgccgtactaccgggccccgtagggacggtaagggtcgttagggaggtggaggtagggagtacggtaactaccgtaacggtaacgtagttacggtactaactaaaacttaaagttcgtacgacgacgtaaggtacggttacggacgggtacgtacggtaccacgagacggaccgacggacctacgtaccatacactacacactacgagtagacgngacgcgngagacgacgtacgtacgacgacgcgtcgttgttattagtgtgagngagtaagtagtaacgttcgttcgttacgtttaacgttaaggttaaggg

SEQ ID NO: 350819 - DNA, 510 bp, Homo sapiens
  misc_feature: GZ8MTXP01BIA87.39.87.H10.1.454.CMB.2.raw
  modified_base (253)..(253): a, c, t, g, unknown or other
  misc_feature (253)..(253): n is a, c, g, or t
  modified_base (329)..(329): a, c, t, g, unknown or other
  misc_feature (329)..(329): n is a, c, g, or t
tcagtcgcactagtcacgaccggtgctcgatttagcagtactgcgttgggtttggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagctggtancagcagaaacaggaaactctaaggtcctgatctatgatgcctcagtttggaagtgggtccatcaaggttccagcgnagtggaatcgtgggacagatttcactctcaccatcacagcctgcggcctagaagtatttgactaattattactgtactaaactaatttaattcttatccgtcttactacgtttcgggacggtacgggaccaagggtgagattacgaaacgacttgttggctgcaacatcttgtcttctaac

SEQ ID NO: 350820 - DNA, 518 bp, Homo sapiens
  misc_feature: GZ8MTXP01CM5DR.39.87.H10.1.454.CMB.2.raw
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (334)..(334): a, c, t, g, unknown or other
  misc_feature (334)..(334): n is a, c, g, or t
  modified_base (384)..(384): a, c, t, g, unknown or other
  misc_feature (384)..(384): n is a, c, g, or t
  modified_base (505)..(505): a, c, t, g, unknown or other
  misc_feature (505)..(505): n is a, c, g, or t
tcagtcgcactagtcacgaccggtgctcgatttagcagtactgcgttgggtttggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaangatttagctggtancagcagaaaccagggaaactcctaaggtcctgatctatgatgcctcagtttggaagtgggtccatcaaggttccagcggnagtggaatcgtgggactagatttcactctcacatcacagctgcgctgatntttgctaacttatactggtactaaactaatttaatcgttatccgtctactacgtttcgggcggtaagggtaccaagggtgaggtaattcgtaaaacgggacttggttcggactgcaacctntcttcgtcttctc

SEQ ID NO: 350821 - DNA, 504 bp, Homo sapiens
  misc_feature: GZ8MTXP01AYTXK.39.87.H10.1.454.CMB.2.raw
  modified_base (407)..(407): a, c, t, g, unknown or other
  misc_feature (407)..(407): n is a, c, g, or t
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctctgcaaggcttctggaatcaccctcaccgacgtctatatgcactggtgcgacaggcccctggacaagggcttgagtggatgggatggatcgaacggtacagtggtctcaactaaattatgcacagtaagttcagggcagggtcacatgacagggacagtcatcaatacagctanatgggaactgacgcgagctgagatctgacgacncggctgttattattgtcgngagngagtggagttcttcttacttacgttgttcggggtttaaggg

SEQ ID NO: 350822 - DNA, 507 bp, Homo sapiens
  misc_feature: GZ8MTXP01DKPHY.39.87.H10.1.454.CMB.2.raw
  modified_base (285)..(285): a, c, t, g, unknown or other
  misc_feature (285)..(285): n is a, c, g, or t
  modified_base (334)..(334): a, c, t, g, unknown or other
  misc_feature (334)..(334): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (468)..(468): a, c, t, g, unknown or other
  misc_feature (468)..(468): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttncgacaggcccctggacaaggcttgagtggatgggatgatcaacggtacngtggtctacacaaaattatgcacagtaagtttcgagggcagggtcacatgacgaggacacgtcatcaatacagactacagtacggaactgagcaggctgagntcngacgacgaacggcgttgtattagttgtgngagagaatggaatactcgttactaacgttgtttaagggg

SEQ ID NO: 350823 - DNA, 501 bp, Homo sapiens
  misc_feature: GZ8MTXP01EGNSJ.39.87.H10.1.454.CMB.2.raw
  modified_base (434)..(434): a, c, t, g, unknown or other
  misc_feature (434)..(434): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagcctggggcctcagtgaaggtctcctgcaaggcttctggaatcaccctcaccgacgtctatatgcactggttgcgacaggcccctggacaagggcttgagtggatgggatggatcaacggtaaccagtggtctcacaaaattatgcacagagtttcagggcagggtcacatgacagggacacgtccatcaatacagacctacagtggaactgagcagctgagntctagacgacaacggcgttggtattagtgtgcgngagntgaagtactcttntaacgttaagttgggg

SEQ ID NO: 350824 - DNA, 523 bp, Homo sapiens
  misc_feature: GZ8MTXP01ERZ6N.39.87.H10.1.454.CMB.2.raw
  modified_base (362)..(362): a, c, t, g, unknown or other
  misc_feature (362)..(362): n is a, c, g, or t
  modified_base (488)..(488): a, c, t, g, unknown or other
  misc_feature (488)..(488): n is a, c, g, or t
  modified_base (508)..(508): a, c, t, g, unknown or other
  misc_feature (508)..(508): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggatgggatggatcgaaacggtaacagtggtctacaaactaaattntgacaacagtaaagtttcgaggggacagggtcaccgatgaccgagggacacgtaccatacaatacagcctaacataggaactgagcaggctagagtatctagacgaacgacgcgtgttattattgngcgagaagatggattacttnttcttaacgttaagg

SEQ ID NO: 350825 - DNA, 525 bp, Homo sapiens
  misc_feature: GZ8MTXP01A8THF.39.87.H10.1.454.CMB.2.raw
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
  modified_base (484)..(484): a, c, t, g, unknown or other
  misc_feature (484)..(484): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacaggcccctggacaagggcttgagtggatgggatggatcgaacggtaaccaggtggtctacgaactaaaaattatgacaacgagtaagtttcgagggcagggtcaccatgacagggacacgtccatcaatacagacctacagtggaactgagcgagctgagntcgtagacgnaacggtccgttgtattagttggtgngagttagaagttgaagttactcttctaagttaagttggggg

SEQ ID NO: 350826 - DNA, 587 bp, Homo sapiens
  misc_feature: GZ8MTXP01D3OOJ.39.87.H10.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccgggnaagtcagggcaattaaaaatgatttagctggtancagcaagaaaaccagggaaaactcctaaaggtcctagatctatgatgcctcgagtttaggaaagtgggtaccatcaaggttcagcggcagtggaatcgtgggactagtatttcactctacaccatcaccagcctgcggcctagaagtattttgactaaactttatactaggtactaaactaaatttaactcttaactccgtacttaccgtacgtttcggacgggtaacgggaacccgaaaagggttcggaaagaacttaaccgaaaacgggtaaacttgggttggacctggacctaaccctaattcccgttagttcctttaacgtaacccg

SEQ ID NO: 350827 - DNA, 530 bp, Homo sapiens
  misc_feature: GZ8MTXP01DYPQG.39.87.H10.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (328)..(328): a, c, t, g, unknown or other
  misc_feature (328)..(328): n is a, c, g, or t
  modified_base (354)..(354): a, c, t, g, unknown or other
  misc_feature (354)..(354): n is a, c, g, or t
  modified_base (383)..(383): a, c, t, g, unknown or other
  misc_feature (383)..(383): n is a, c, g, or t
  modified_base (437)..(437): a, c, t, g, unknown or other
  misc_feature (437)..(437): n is a, c, g, or t
  modified_base (525)..(525): a, c, t, g, unknown or other
  misc_feature (525)..(525): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggnaagtcaggcattaaaangattagctggtancagcagaaaccagggaaaactcctaaggtcctgatctatgatgcctcagtttggaagtgggtccatcaagtcagcgnagtgaatctgggacagatttcactcncacatcacagcctagcggacctgaacgtntttgactaaactttattacctggtactaaactaaattttaattcttaacgtccncttactacgtttccgggacggtacgggaaccaaggtggaagtattacgaaaacgtacttggttggctgacaaccgatcttgtcctttntaacc

SEQ ID NO: 350828 - DNA, 523 bp, Homo sapiens
  misc_feature: GZ8MTXP01BZSR3.39.87.H10.1.454.CMB.2.raw
  modified_base (226)..(226): a, c, t, g, unknown or other
  misc_feature (226)..(226): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcattaaaatgattagctggtatcagcagaaaccaggaaactctaaaggtcctgatctatgatgcctcagtttggaaagtggggtccagtccaaggttcagcggcaagtggaatcgtgggacagtatttcactctcacatcacagcctgcgcctgaagtatttgactaacttattactgtactaaactaatttaattcttaatccgtcttctacgtttcgggcggaagggtaccaagggtcggagtacgtacgaaacgacgttggtaaggctgcacttatcgttgttcc

SEQ ID NO: 350829 - DNA, 595 bp, Homo sapiens
  misc_feature: GZ8MTXP01BJVM9.39.87.H10.1.454.CMB.2.raw
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (409)..(409): a, c, t, g, unknown or other
  misc_feature (409)..(409): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccggnaagtcaggcaattaaaatgattagctggtancagcaagaaacaggaaacnccctaagctcgtgtctcgtggtcncctctagtttgacgtaaggtcgggtacccatacgaaggttccaggcggacagtagaaatcgtgggacaagtaacttcactctacaccatacagcaacgtgacagtcgtggtntatttgacttaactttactacgtcgtaccagtactaacttaattaacttaccctttaacccttacttacgttttacgggacccgtaagggggtaaccctaagggacttaagaacgtaagtaaaccgaaaaagttccgttagggtaacggacctcggtaacctaccgttaacttccgtttcgttccc

SEQ ID NO: 350830 - DNA, 765 bp, Homo sapiens
  misc_feature: GZ8MTXP01B1E8G.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttcgaggaatccaccctcacccgacgtctatatgcactggtgcgacacggcccctggacaagggcttggagtggagtgggatggatacgaaacggtaacaggtggtactacaactaaaatttaagtcgaaccaaacgtaaagggtaaacgttttacgaagggggtactaagggggttacccaacccgtaagttacggaaaccccgaagggggtaacccaaccgggttacccgaaagttaaccgaaaacttaaacccgaacggtaacccccttaaagtaacggttaacggggggtaaaacccgttagggaaaccggtccgggaacgggtaccgttaagggaaacggtaaccgtaccgttaacgggaaccccgtaacggaaacccggggtcccgttaaggttaacgtttaaacgttcggttacgggtacggttaaagggacggttaagttaaggggtaacgtttaacccgtttaccgttaccctttaacggttaaacggttttcgggggttttaaacgggggg

SEQ ID NO: 350831 - DNA, 533 bp, Homo sapiens
  misc_feature: GZ8MTXP01AHSAZ.39.87.H10.1.454.CMB.2.raw
  modified_base (222)..(222): a, c, t, g, unknown or other
  misc_feature (222)..(222): n is a, c, g, or t
  modified_base (252)..(252): a, c, t, g, unknown or other
  misc_feature (252)..(252): n is a, c, g, or t
  modified_base (391)..(391): a, c, t, g, unknown or other
  misc_feature (391)..(391): n is a, c, g, or t
  modified_base (521)..(521): a, c, t, g, unknown or other
  misc_feature (521)..(521): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccgaggtgccagatgtgccatccagttgacccagtctccatcctccctgtctgcatctgtaggagacagagtcaccatcacctgccggnaagtcagggcattaaaatgattagctgtancagcagaaacaggaaactcctaaggtcctgatctatgatgcctcagtttggaaagtggggtccagtcaaggttcaggcggcaggtgaatcgtgggactagtatttcactctcaccatcacagcctggcgctagaacgtntttcgactaacttattactggtaactaaacttaatttaacttcttactcctacttcgtacgtttcgggaccggtagggaccgtaaaggtggaagtacttacgaaacgtacttggttcggctgctaacctntcttctcttctc

SEQ ID NO: 350832 - DNA, 614 bp, Homo sapiens
  misc_feature: GZ8MTXP01D61VD.39.87.H10.1.454.CMB.2.raw
  modified_base (542)..(542): a, c, t, g, unknown or other
  misc_feature (542)..(542): n is a, c, g, or t
  modified_base (552)..(552): a, c, t, g, unknown or other
  misc_feature (552)..(552): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcgagtgaaggtctcctgcaaggcttctggaactccaccctcaccgacgtctatatgctacgtggttcgcgacgacggcccctaggacgaagggtcttggagtggagtgggatggatacgaaacggtacagtggtactacaactaaattatgccagaaggtaacggtttcgaaggggtacgagggtaccaccgtagtacgaaccgagggactacgtaccatacaatacacgactaacgtacgtaggggaactcggagcgaggtcgtaggaagtacgtacgtaggaaccgcgaaccgggtccgttagttacgttagtttaggngtacgaaggngttagtaaggtaacgttaactttacgttaccgttaacgttaaggtttcgggggtttaagggg

SEQ ID NO: 350833 - DNA, 583 bp, Homo sapiens
  misc_feature: GZ8MTXP01B3CZ2.39.87.H10.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcaattaaaaangatttagctggtancagcagaaacagggaaactctaaggtcctgatctatgatgctcagtttggaaagtgggtaccatcaaggttccagcggcagtggaatctgggacagtatttcactctcaccatcaccagcctgcggacctgaagtatttgactaacttattactggtactaaactaatttaattcttaatcccgtacttacctacgtttccgggacgggtaacgggggacccgtaaaggggtcggaaaggtaacttaaccgaaaaacggtaacgttagggttcgggttaccttgggaccctaacccgtaagttccttacgttcccttttccgtaacc

SEQ ID NO: 350834 - DNA, 509 bp, Homo sapiens
  misc_feature: GZ8MTXP01CVUOQ.39.87.H10.1.454.CMB.2.raw
  modified_base (338)..(338): a, c, t, g, unknown or other
  misc_feature (338)..(338): n is a, c, g, or t
  modified_base (356)..(356): a, c, t, g, unknown or other
  misc_feature (356)..(356): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaaccggtanagtggtctcaacaaattntgcacagagttcagggcagggtcacatgaccagggacacgtccatcaatacagcctacgataggaactggagcgaggctaggagtatcgtagaccgaacacgggcgtgttattagtgttgcgagaagatgagtacttcttcgttaacgttaag

SEQ ID NO: 350835 - DNA, 572 bp, Homo sapiens
  misc_feature: GZ8MTXP01CZWUL.39.87.H10.1.454.CMB.2.raw
  modified_base (467)..(467): a, c, t, g, unknown or other
  misc_feature (467)..(467): n is a, c, g, or t
  modified_base (536)..(536): a, c, t, g, unknown or other
  misc_feature (536)..(536): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagccgtggggcctcgagtgaaggtctccgtgcaagggcttcgtaggaactccacccctcaccgacgtctatatgcacgtggtgcgacacggcccctaggacgaggcgttggaggtaggagtagggagtaggagtacgaacggtaacgaggtggtctacaactaaaaattatcgacaacgtaagtaagttacgagggacgagggtaccacagtacgaaccgagggacaaccgtcaagtacaaactacacgtaccctanaggtaggaaaccgtgacggcgcgagacgaaggcgtcaacggagcgaacggtcgttagtattgtgtgagngagaagtagtaagtactacttactaacgttgtaagg

SEQ ID NO: 350836 - DNA, 567 bp, Homo sapiens
  misc_feature: GZ8MTXP01DRN3U.39.87.H10.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccgggnaagtcagggacaattaaaatgtatttagctggtancagacaagaaaccaggaaaactctaaagtcctagatctatgatgcctctaggtttaggaaagtgggtacccagtcgaaaggttccaggcggacagtggaatcgtgggactagtatttcactctacaccatcaccagctgcggctagaagtatttgactaacttatactagtactaaattaatttattcttactccgacttactacgtttcgggacgggtaacgggaccgtaaagggtgagtaacttaaccgaaaacgtaacgttggttagccgttaagacctaacctatcgttacttcctttcgtaaccg

SEQ ID NO: 350837 - DNA, 574 bp, Homo sapiens
  misc_feature: GZ8MTXP01ATR05.39.87.H10.1.454.CMB.2.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
tcagtcgcactagtcacgaccggtgctcgatttagcagtactgcgttgggtttggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcaattaaaangattagctggtancagcaagaaaccagggaaaactcctaaggtcctagatctatgatgcctcagtttggaaagtgggtcccatcgaaggttcaggcggcaggtggaatcgtgggacagtatttcactctcaccatcaccagcctgcggcctagaagtattttgactaaactttattactacggttaactaaacttaaattttaactttactttaactcccgtacttacctaaccgttttcggggacggtaacggggtacccgtaaaaggggtcgaaggtaacttaccgaaaacgtacgttgttggactgaccaactatcgttattccttctaac

SEQ ID NO: 350838 - DNA, 518 bp, Homo sapiens
  misc_feature: GZ8MTXP01DME8R.39.87.H10.1.454.CMB.2.raw
  modified_base (357)..(357): a, c, t, g, unknown or other
  misc_feature (357)..(357): n is a, c, g, or t
  modified_base (419)..(419): a, c, t, g, unknown or other
  misc_feature (419)..(419): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccatccccaggtgcagctggtgcagtccgggactgaggtgaagaagcctggggcctcagtgaaggtctcctgcaaggcttctggaatcaccctcaccgacgtctatatgcactggttgcgacacggcccctggaccaagggcttgagtggatgggatggatcaacggtacagtgtctacaacaaattngacaacagaagtttcgagggcagggtcaccatgaccagggacacgtcatcaatacagcctanatggaactgagcgaggctagagtatcgtgacgaacgacggccgttgttaattagttggagttcgagaagatgacgttacttctttcgttaacttaaggg

SEQ ID NO: 350839 - DNA, 543 bp, Homo sapiens
  misc_feature: GZ8MTXP01A124B.39.87.H10.1.454.CMB.2.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggnaagtcagggcaattaaaangattagctggancagcagaaacaggaaactcctaaggtcctgatctatgatgcctcctaggtttaggaaagtgggtacccagtcgaaggttccaggcggcgagtggaatcgtgggacagtattcactctacaccatcagcaacgtgcacgcttaggtgtattttgacttaactttattacgtgcctagctaacttattactacctttacccgttataccgtttagcccgtaaggggaacctaagactaagaagaagtaacaaaacgcgttaggtcgctaacgcaccttattccgttaagttcc

SEQ ID NO: 350840 - DNA, 577 bp, Homo sapiens
  misc_feature: GZ8MTXP01CG5NX.39.87.H10.1.454.CMB.2.raw
  modified_base (360)..(360): a, c, t, g, unknown or other
  misc_feature (360)..(360): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggacaattaaaatgattagctggtatcagacaagaaaccaggaaactccgtaaaggtcctagatctatgatgaccctcgaggtttaggaaacgtggggtcccagtccaaggttcagcgcgaagtggntcgtgggacagtattcactctacacatcaccagcctgccggactagaagtatttcgactaaactttacttattacgtacaaacgtaggtaccttaaacgtacggttttaccccggaggtaccgttaccggacgaaagggtaacccaaagggttacgaaacttacgaaaacgtagttcggttgacgtgacctaactatccgttagttccttcgtaacg

SEQ ID NO: 350841 - DNA, 584 bp, Homo sapiens
  misc_feature: GZ8MTXP01EFJOI.39.87.H10.1.454.CMB.2.raw
  modified_base (201)..(201): a, c, t, g, unknown or other
  misc_feature (201)..(201): n is a, c, g, or t
  modified_base (495)..(495): a, c, t, g, unknown or other
  misc_feature (495)..(495): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccgggcaagtcagggacaattaaaatgatttagctggtatcagacaagaaaccagggaaaactccgaaaggtcctagatctatgatcgcccttcgtaggtttaggaaagtcggggtacccataccgaaggttcaaggtcggactaaggtggaagtcgtaggggactagtactttcactctacaccatccacagtcctaggccggtactagtaatattttcgacttaactttagttacttgtaactaaacttaattttaacttccttaatcccgtnttaccgtacgtttcgggcggtaacgggtaacttaaggggtgaagtactaacgaaacgttcgttgtaaggctcgacaccattcttgttcc

SEQ ID NO: 350842 - DNA, 503 bp, Homo sapiens
  misc_feature: GZ8MTXP01BIM86.39.87.H10.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (385)..(385): a, c, t, g, unknown or other
  misc_feature (385)..(385): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgatctggctcccaggtgccagatgtgccatccagttgacccagtctccatcctccctgtctgcatctgtagganacagagtcaccatcacttgccgggnaagtcagggcaattaaaangattagctggtancagcagaaacaggaaactctaaggtcctgatctatgatgcctcagtttggaaagtgggtaccatcaaggtcaggcgcagtgaatcgtgggacagtatttcactctcaccatcacagctgcggctagaagtntttgactaacttattactggtaactaaactaatttaacttcttatccgcttacgtcttcgggcggtaggacaaggtgagattacgaaacgattggngctgcaactntcttctcttctn

SEQ ID NO: 350843 - DNA, 517 bp, Homo sapiens
  misc_feature: GZ8MTXP01BWX9Y.39.87.H10.1.454.CMB.2.raw
  modified_base (355)..(355): a, c, t, g, unknown or other
  misc_feature (355)..(355): n is a, c, g, or t
  modified_base (418)..(418): a, c, t, g, unknown or other
  misc_feature (418)..(418): n is a, c, g, or t
  modified_base (447)..(447): a, c, t, g, unknown or other
  misc_feature (447)..(447): n is a, c, g, or t
  modified_base (488)..(488): a, c, t, g, unknown or other
  misc_feature (488)..(488): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatggatggatcgaacggtacagtggtctcaaacaaattntgcacagtaagtttcgagggcagggtcacatgaccagggacacgtccatcaatacagacctanataggaactgagcaggctagagtactcgngacggaacaacgggccgtagttattaagtgttgcgagaagntgagttacttcttaacgttaagttaaggg

SEQ ID NO: 350844 - DNA, 514 bp, Homo sapiens
  misc_feature: GZ8MTXP01BG359.39.87.H10.1.454.CMB.2.raw
  modified_base (357)..(357): a, c, t, g, unknown or other
  misc_feature (357)..(357): n is a, c, g, or t
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaggtctctgcaggctctggatcaccctcaccgacgtctatatgcacgtggttgcgacacggcccctggacaagggcttggagtggagtgggatggatcgaaccggtacagtggtctacaaacaaattngacacagtaagttcgagggcagggtcacatcgaccgagggaccacgtcatacaatacagcctagagtaggaactggacgcggacgtaggacgagacgtcgacgtacgaacgacggctgttatgtgttgngagaagagngtagtattctcgttctaag

SEQ ID NO: 350845 - DNA, 516 bp, Homo sapiens
  misc_feature: GZ8MTXP01DW89N.39.87.H10.1.454.CMB.2.raw
  modified_base (247)..(247): a, c, t, g, unknown or other
  misc_feature (247)..(247): n is a, c, g, or t
  modified_base (439)..(439): a, c, t, g, unknown or other
  misc_feature (439)..(439): n is a, c, g, or t
  modified_base (482)..(482): a, c, t, g, unknown or other
  misc_feature (482)..(482): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagcctggggcctcagtgaaggtctcctgcaaggcttcnggaatcaccctcaccgacgtctatatgcactggttgcgacaggcccctggacaaggcttgagtggatgggatggatcgaacggtaaccaggtggtctcaacaaaattatgacacagtaagttcagggcagggtcacatgacaggacacgtcatacaatacagacctacagtaggaactgagcgaggctgaantctagacgacgaacggtcgttagtatttagtgtgcgttagagntagaagttactcttactaagttaagtttaagggg

SEQ ID NO: 350846 - DNA, 521 bp, Homo sapiens
  misc_feature: GZ8MTXP01DAQFB.39.87.H10.1.454.CMB.2.raw
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
  modified_base (319)..(319): a, c, t, g, unknown or other
  misc_feature (319)..(319): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccgggnaagtcagggcaattaaaatgattagctgtancagcagaaacaggaaactctaagtctgatcatgatgctcagtttggaagtggtccatcaagtccagngcagtgatctgggacagtattcactctcaccatcaccagcctgcgactagaagtatttgactaacttactattcggtacaaacgaggtactaacgtacgtttcccggaggtaccgttcggaccgtaaaggggaccaaagggtaacggaaaattcgaaaacgacgtgtagcttgaccaacatctgtcttcaacttccgtcccg

SEQ ID NO: 350847 - DNA, 571 bp, Homo sapiens
  misc_feature: GZ8MTXP01D2TLB.39.87.H10.1.454.CMB.2.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (399)..(399): a, c, t, g, unknown or other
  misc_feature (399)..(399): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcaattaaaangattagctggtancagacaagaaaccagggaaaactcctaaggtcctagatctatgatgcctctagtttggaaagtgggtaccatacaaggttcccaggcggcagtgaatcgtgggacagtatttcactctcaccatcacagctgcggactagaagtntttgactaattattacctagtactaaacttaatttaacttcttaactccgacttacgtaacgtttcggggacggaacgggacctaaaggggtgaaggtaaacttaccgaaaacggtaacgttgggttgggacctaaggcctaaccgtattccttagtttaaccttctaaccg

SEQ ID NO: 350848 - DNA, 547 bp, Homo sapiens
  misc_feature: GZ8MTXP01D193H.39.87.H10.1.454.CMB.2.raw
  modified_base (227)..(227): a, c, t, g, unknown or other
  misc_feature (227)..(227): n is a, c, g, or t
  modified_base (371)..(371): a, c, t, g, unknown or other
  misc_feature (371)..(371): n is a, c, g, or t
  modified_base (514)..(514): a, c, t, g, unknown or other
  misc_feature (514)..(514): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagccgtggggcctnagtgaaggtctcctgcaaggcttcgtggaactcaccctcaccgacgtctatatgctacgtggtgcgacgacggcccctggacaaggctgagtggagtggatggatacgaaaccggtaacaggtcggtactacaaaactaaattngacaacagtaagttcgagggcagggtcaaccagtcgaaccgagggaaccacgtaccaatacaaatacgaagccctaagagtacggaaactggaacgcgagcgtagagtcgtacagacgaacacggttctagttatagttgagngagaagtatgtatacttcttcttaagttaaggg

SEQ ID NO: 350849 - DNA, 543 bp, Homo sapiens
  misc_feature: GZ8MTXP01APKRR.39.87.H10.1.454.CMB.2.raw
  modified_base (418)..(418): a, c, t, g, unknown or other
  misc_feature (418)..(418): n is a, c, g, or t
  modified_base (493)..(493): a, c, t, g, unknown or other
  misc_feature (493)..(493): n is a, c, g, or t
tcagtcgcactagtcacgaccggtgctcgatttagcagtactgcgttgggtttgggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcacccgacgtctatatgcactggtgcgacacggcccctggacagggcttgagtggatgggatggatcgaaacggtacagtggtctcacaaattatgcacagtaagttcgagggcagggtcacatgacgagggacacgtaccatacaatacacgcctaacngtacggggaactgagacgtaggcgtagagactcgtagaccgacgcggtccgtgttattagttggtcggtacgagngttagtgtacgttaacttcttaccgttacttaaggttgggtttaacgggg

SEQ ID NO: 350850 - DNA, 582 bp, Homo sapiens
  misc_feature: GZ8MTXP01AZH3D.39.87.H10.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (411)..(411): a, c, t, g, unknown or other
  misc_feature (411)..(411): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccgggnaagtcagggacaattaaaatgtatttagctggtancagacaagaaaccagggaaactcgtaagtcctagatctatgatcgcctcgtagtttaggaaaggtcgggtacccagtcgaaggttccaggcggcgagtggaatcgtgggactagtacttcactctacaccatcaccagcctgcgactagaagtntttgactaacttattactagtactaaattaatttacttcttactccgtacttaccgtacgtttccggggacggtaacgggaaccgtaaggggtaggaacggtaacttaccgaaaacggtacgttaggttcggacctaagaccaaccgtattccttacgttccttcgtaacc

SEQ ID NO: 350851 - DNA, 611 bp, Homo sapiens
  misc_feature: GZ8MTXP01EXLP9.39.87.H10.1.454.CMB.2.raw
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgattagcctggtatcagcaagaaaccaggaaaactcctaaaggtcctgatctatgatcgccctccgtagtttaggaaagtcgggggtaccccagtacccgaaggttcaggtcggctaaggtggaatcgtaggggactaggtatttcacttctacaccatccaccagtccctacggccgtcctagaagttattttaggactaactttattactgttactaaacttaaattttaacttccttaactccgtactccgtaacgtttcggggacgggtaacggggtaccaaaggggtcggaaggtaacttaacgaaaacggttacttggttcgggcttaacggaccacccttaagttcctttcggttccc

SEQ ID NO: 350852 - DNA, 523 bp, Homo sapiens
  misc_feature: GZ8MTXP01BENTE.39.87.H10.1.454.CMB.2.raw
  modified_base (248)..(248): a, c, t, g, unknown or other
  misc_feature (248)..(248): n is a, c, g, or t
  modified_base (356)..(356): a, c, t, g, unknown or other
  misc_feature (356)..(356): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttcnggaatcaccctcaccgacgtctatatgcactggttgcgacacggcccctggacaagggcttggagtggatgggatggatcgaacggtacagtggtctacacaaaattntgacaacagaagtttcagggtcagggtcacatgaccgaggacacgtccatacaaatacagcctacagtaggaactgagcgaggcgtagagactcgtagacgacgaacggcgttgtacttagtgtgacgngagaagtgtaacgtactnttacgtaacgttgtaagggg

SEQ ID NO: 350853 - DNA, 512 bp, Homo sapiens
  misc_feature: GZ8MTXP01APO3D.39.87.H10.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (400)..(400): a, c, t, g, unknown or other
  misc_feature (400)..(400): n is a, c, g, or t
  modified_base (497)..(497): a, c, t, g, unknown or other
  misc_feature (497)..(497): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgcggnaagtcagggcaattaaaatgattagctggtancagcagaaaccagggaaactcgtaaggtcctgatctatgatgcctcagtttggaagtggccatcagtcagcgcagtggaatcgtggacagtatttcactctcacatcacagcctgcggtacctggaactatttagactaattattacngttacaaattaatttaacttcttaatccgtacttctaacgttcggacggagggtaaccaagggtgagtattacgaaagtacttgttcgctgctaacntcttcgtcttctaac

SEQ ID NO: 350854 - DNA, 515 bp, Homo sapiens
  misc_feature: GZ8MTXP01D0K8B.39.87.H10.1.454.CMB.2.raw
  modified_base (248)..(248): a, c, t, g, unknown or other
  misc_feature (248)..(248): n is a, c, g, or t
  modified_base (357)..(357): a, c, t, g, unknown or other
  misc_feature (357)..(357): n is a, c, g, or t
  modified_base (441)..(441): a, c, t, g, unknown or other
  misc_feature (441)..(441): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttcnggaatcaccctcaccgacgtctatatgcactggttgcgacaggcccctggacaagggcttgagtggatgggatggatcgaacggtaaccaggtggtctacacaaaattntgcacagtagtttcagggcagggtcacatgacagggacacgtcatcaatacagacctacagtaggaactgagcgaggctgaagntcgtagacgacaacggtcgttgtattagtggtgacgngagntagaagttactcttactaacgttgtttaagggg

SEQ ID NO: 350855 - DNA, 705 bp, Homo sapiens
  misc_feature: GZ8MTXP01C1X50.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctgagtgaaggtctcctgcaaggcttcgtggaactccaccctcaccgacgtctatatgcacgtggttcgcgacgacggccccgtggacaagggtcttaggagttggagtgggatggatacgaaaccggtacaggttggtactacgaaaactaaattgtagacctaaacgtaaggtaacgtttcgggaagggtacgtacggggtaccaaccgtagtacggaaccgaaggggaaccctaccggttaccaagtaccaaataaccgaacgtaccccttaagaacgttaacggggaacctagggaacgaccgaacggtcgttaacgggaagtacgttaccgaacggtaaccgggtaacgaaccggggttcccgggtttaattaaagttttaacggtttacgggttacggttcgggaaaggtaaggtaacgttaagggttaaccgttaactttcccgttttaaccgttaacggttttaacggggg

SEQ ID NO: 350856 - DNA, 529 bp, Homo sapiens
  misc_feature: GZ8MTXP01BLHCH.39.87.H10.1.454.CMB.2.raw
  modified_base (351)..(351): a, c, t, g, unknown or other
  misc_feature (351)..(351): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacacggcccctggacaggcttgagtggatgggatggatcgaacggtacagtggtctacaacaattangcacagtaagtttcgagggcagggtcacgatgacgagggacacgtaccatacaatacagcctaacagtaggggaactgacgcgaggctaggagatcgtagacgacgcggcgtgttattagttgtagcgttagagttagtgaacgttcttcttcgttagttaagttggggttaacgggg

SEQ ID NO: 350857 - DNA, 576 bp, Homo sapiens
  misc_feature: GZ8MTXP01DBUCQ.39.87.H10.1.454.CMB.2.raw
  modified_base (256)..(256): a, c, t, g, unknown or other
  misc_feature (256)..(256): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggacaattaaaatgtattagctggtancagcagaaaccaggaaactccgtaagtcctgatctatgatgcctaccgtagtttagggaaacggttggggtaccccagtcgtaaggttccaggcggcgaggtggaatcgtgggactagtactttcacttctacacatcaccagccgtgccggactagaagttatttacgactaactttattactaggttaactaattaatttacttcttactccgtctacgtacgttcgggacggtacgggaaccgtaagggtggaagtacgttaacgaaaacgtaacgttggttggctgacctaacctagttcttgttccttcgtaacc

SEQ ID NO: 350858 - DNA, 532 bp, Homo sapiens
  misc_feature: GZ8MTXP01DFQI8.39.87.H10.1.454.CMB.2.raw
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttncgacaggcccctggacaagggcttgagtggatgggatggatcaaacggtaacagtggtctacaaacaaatttaangacaanagtaagttcgagggcgaggtcacatagacgaggacacgtacananaanaacanacacgagtagacgagagacgagacgtagagtatcgtacgaacgaacgaacggacgtagttagttagttgttgcgagaagagtaagtagtacttacttaacgttaacgtaag

SEQ ID NO: 350859 - DNA, 548 bp, Homo sapiens
  misc_feature: GZ8MTXP01DHP5O.39.87.H10.1.454.CMB.2.raw
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
  modified_base (423)..(423): a, c, t, g, unknown or other
  misc_feature (423)..(423): n is a, c, g, or t
  modified_base (496)..(496): a, c, t, g, unknown or other
  misc_feature (496)..(496): n is a, c, g, or t
  modified_base (503)..(503): a, c, t, g, unknown or other
  misc_feature (503)..(503): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagcctgggcctcagtgagtctctgcaggctctgatcacctcaccgacgtctatatgcacgtggttgcgacacggcccctggacgaagggcttggagtggagtgggatggatcgaaacggtacngtggtctacaacaaattangcacagtaaacgtttcgaggggcagggtcaccgagtcgacgagggacacgtaccatacaatacacgacctanacgttaggggaaactggacgcgaaggcgtagacgaacttcgtagaccgacgcggtcgttgttattagtttggngaggagngttagtgtacgttcttcttacgttacgttaaggttgggttaaggg

SEQ ID NO: 350860 - DNA, 525 bp, Homo sapiens
  misc_feature: GZ8MTXP01DV16A.39.87.H10.1.454.CMB.2.raw
  modified_base (246)..(246): a, c, t, g, unknown or other
  misc_feature (246)..(246): n is a, c, g, or t
  modified_base (423)..(423): a, c, t, g, unknown or other
  misc_feature (423)..(423): n is a, c, g, or t
  modified_base (503)..(503): a, c, t, g, unknown or other
  misc_feature (503)..(503): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctgggcctcagtgaggtctcctgcaaggcttcnggaatcaccctcaccgacgtctatatgcactggtgcgacacggcccctggacaagggcttgagtggatgggatggatcgaacggtaaccaggtggtctacaactaaaaattatgacaacagtaagtttcgaggggcagggtcacatgacagggacacgtcatacaatacagacctanagtaggaactgacgcgaggctaggagacgtcagacgacaacggtcgttgtattgtagtgacggagagtaatgtaacgttntcttactaacgttgttaagggg

SEQ ID NO: 350861 - DNA, 539 bp, Homo sapiens
  misc_feature: GZ8MTXP01CRY4W.39.87.H10.1.454.CMB.2.raw
  modified_base (222)..(222): a, c, t, g, unknown or other
  misc_feature (222)..(222): n is a, c, g, or t
  modified_base (259)..(259): a, c, t, g, unknown or other
  misc_feature (259)..(259): n is a, c, g, or t
  modified_base (393)..(393): a, c, t, g, unknown or other
  misc_feature (393)..(393): n is a, c, g, or t
  modified_base (409)..(409): a, c, t, g, unknown or other
  misc_feature (409)..(409): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcctaggtgccagatgtgccatccagttgacccagtctccatcctccctgtctgcatctgtaggagacagagtcaccatcacttgccgggnaagtcagggactaattaaaaatgatttagcctggtancagcaagaaaccagggaaactccgtaagtcctgatctatgatcgcctcgtagtttaggaaacgtggggtacccaagtcgaaggttccaggcggctagtggaatcgtgggactagtattcactctcaccatcacngctgcgtctagaagtnttgactaacttatactgtacaatattatctactcgtctctacgttcggacgtaggccgtaagggtggaagtacttacgaaaacgtcgttcggttggctgactaacctagttccttagttccttcgtaacc

SEQ ID NO: 350862 - DNA, 563 bp, Homo sapiens
  misc_feature: GZ8MTXP01C6JJ9.39.87.H10.1.454.CMB.2.raw
  modified_base (258)..(258): a, c, t, g, unknown or other
  misc_feature (258)..(258): n is a, c, g, or t
  modified_base (365)..(365): a, c, t, g, unknown or other
  misc_feature (365)..(365): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccgggcaagtcagggactaattaaaatgtatttagcctggtancagcaagaaaccagggaaactcctaaggtcctagatctatgatgcctcgtaggtttaggaaaggttggggtacccagtcgaaggttccaggcggcaggtggaatcgngggactagtatttcactctacaccatcaccagcctgcggactagaagtatttagactaattatactgtactaactaatttatcttactccgtctactcgttcgggacggacgggtaaccgaagggtgaagtacttaacgaaaacgtacttggttcggactaacgacctaaccgtattcttacgttccttcgtaacccg

SEQ ID NO: 350863 - DNA, 601 bp, Homo sapiens
  misc_feature: GZ8MTXP01EEECO.39.87.H10.1.454.CMB.2.raw
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaangtatttagcctggtancagcaagaaaccgaggaaactcctaaggtcctagatctatgatcacctcgtagtttaggaaacggtcggggtaccccatcgtaaaggttccaaggcggcgaggtggaatcgtgggacagtactttcactctacacatccacagcctgcggacctaggtaatatttgacctaattatactggtaactaaacttaaatttagttaccttactccgtacttaccgtacgtttccgggacggaacgggtaacgaaagggttggaaaggaacttaacgaaaaccggtaacgttggttcgggttactaacgaccgtaactacttccgttacgttccgtttccgtaacccg

SEQ ID NO: 350864 - DNA, 486 bp, Homo sapiens
  misc_feature: GZ8MTXP01EBZZW.39.87.H10.1.454.CMB.2.raw
  modified_base (247)..(247): a, c, t, g, unknown or other
  misc_feature (247)..(247): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (459)..(460): a, c, t, g, unknown or other
  misc_feature (459)..(460): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (470)..(474): a, c, t, g, unknown or other
  misc_feature (470)..(474): n is a, c, g, or t
  modified_base (476)..(476): a, c, t, g, unknown or other
  misc_feature (476)..(476): n is a, c, g, or t
  modified_base (478)..(479): a, c, t, g, unknown or other
  misc_feature (478)..(479): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttcnggaatcaccctcaccgacgtctatatgcactggtgcgacaggcccctggacaagggcttgagtggatgggatggatcgaaacggtacagtggtctnaacaattaangcacagtaaagtttcaggggcagggtcacatgacagggacacgtaccatacaatacagctacataggggaactggagcggagtcgngagactntagacgangngtnntngngngngnnnnntntnntgttgtg

SEQ ID NO: 350865 - DNA, 535 bp, Homo sapiens
  misc_feature: GZ8MTXP01C3YQ1.39.87.H10.1.454.CMB.2.raw
  modified_base (424)..(424): a, c, t, g, unknown or other
  misc_feature (424)..(424): n is a, c, g, or t
  modified_base (497)..(497): a, c, t, g, unknown or other
  misc_feature (497)..(497): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcgagtgaaggtctcctgcaaggcttctggaatcaccctcaccgacgtctatatgcacgtggtgcgacaggcccctggacaagggcttgagtggatgggatggatcgaaacggtaacaggtggtctcgaacaaattaatgcacagtaaagtttcgagggcagggtcacatcgacgagggacacgcatacaatacagaccctaanacgtaggggaaactggaacgcgaaggcgtagaagactctagacgacgacggcgtgttattagttgtcgagagngatgagtaactcttacgttattaagttgggtttaaggg

SEQ ID NO: 350866 - DNA, 587 bp, Homo sapiens
  misc_feature: GZ8MTXP01C68LZ.39.87.H10.1.454.CMB.2.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
  modified_base (342)..(342): a, c, t, g, unknown or other
  misc_feature (342)..(342): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccgggcaagtcagggacaattaaaaatgatttagcctggtancagcaagaaaccagggaaaactcctaaggtcctagatctatgatgcctctagtttggaaagtgggtccatcaaggttcagcggnagtgaatcgtgggacagattcactctcacatcaccagcctgcggctagtaacgtatttgactaacttacttactaggtaaccctaaacgtaagttaattaaactttaccgtttaccccgttaattaccgttttcgggaccgtaacgggggaaccctaaaggtccgttaggagtaccttaacgaaaaccggtaacttggttcgggacttcggaccctaacctattcccttgttcctttcgtaaccc

SEQ ID NO: 350867 - DNA, 567 bp, Homo sapiens
  misc_feature: GZ8MTXP01D5EAP.39.87.H10.1.454.CMB.2.raw
  modified_base (226)..(226): a, c, t, g, unknown or other
  misc_feature (226)..(226): n is a, c, g, or t
  modified_base (292)..(292): a, c, t, g, unknown or other
  misc_feature (292)..(292): n is a, c, g, or t
  modified_base (365)..(365): a, c, t, g, unknown or other
  misc_feature (365)..(365): n is a, c, g, or t
tcagtcgcactagtcacgaccggtgctcgatttagcagtactgcgttgggtttgggggagcatcacccagcaaccacatctgtcctctagagaatcccctgagagatccgttcctcaccatggactggacctggaggatcctcttcttggtggcagcagccacaggagcccactccccaggtgcagctggtgcagtccgggactgaggtgaagagcctggggcctnagtgaaggtctcctgcaaggcttctggaatcaccctcaccgacgtctatatgcactggttgcgacncggcccctggacaagggcttggagtggagtggatggatcgaaacggtaacaggtggtctacgaaacaaattgngacacagtaagttcgagggtcagggtcacatgacgagggacacgtcatacaatacacgtaccctagaagttacggaactagacgacgaggcgtagagtatacgtagaaccggaacgaaccgggttcgttagttaagttagttggttacggttgagtaagtattgggtaacttacttacgtttaacgttaaccgtttaagggg

SEQ ID NO: 350868 - DNA, 532 bp, Homo sapiens
  misc_feature: GZ8MTXP01APONA.39.87.H10.1.454.CMB.2.raw
  modified_base (251)..(251): a, c, t, g, unknown or other
  misc_feature (251)..(251): n is a, c, g, or t
  modified_base (355)..(355): a, c, t, g, unknown or other
  misc_feature (355)..(355): n is a, c, g, or t
  modified_base (481)..(481): a, c, t, g, unknown or other
  misc_feature (481)..(481): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttcnggaatcaccctcaccgacgtctatatgcactggttgcgacaggcccctggacagggctgagtggatgggatggatcgaacggtacaggtgtctacacaaaattntgcaacgagtagtttcgaggggcagggtcacatcgacagggacacgtcatcaatacagctacagtaggaactgacgcgaggctggaagctcgtagacgacgaacgggtcgttaggtaattgttggngacggttagacgtaattgaacgtttactcgttctaacggttaagttggggg

SEQ ID NO: 350869 - DNA, 566 bp, Homo sapiens
  misc_feature: GZ8MTXP01DCY14.39.87.H10.1.454.CMB.2.raw
  modified_base (257)..(257): a, c, t, g, unknown or other
  misc_feature (257)..(257): n is a, c, g, or t
  modified_base (342)..(342): a, c, t, g, unknown or other
  misc_feature (342)..(342): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggacaattaaaaatgatttagctggtancagcagaaaccagggaaactcctaaggtcctagatctatgatgcctcgagtttggaaagtgggtacccatcaaggttccagcggnagtgaatcgtgggacagtatttcactctacaccatcaccagcctgcgactagagtatttgactaattattactaggttactaaacttaatttattcttactccgtctactacgtttcgggacggtaacgggacctaaagggtcggagtaacgttaacgaaaacggtacgttagggttcggaccgtaacgcctaaccgtacttcgttcgttccttaacgtaaccc

SEQ ID NO: 350870 - DNA, 680 bp, Homo sapiens
  misc_feature: GZ8MTXP01C68AX.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcgagtgaaggtctcctgcaaggcttctaggaactccaccctcgaccgacgtctatatgcacgtggtgcgacgacggcccctaggacgaagggcttaggagtggagtgggatggatacgaacggtaacaggtcggtactacaaactaaattaatcgaacaaacgtaaaggttaaacggtttacggaacgggggtacgaacggggtacccaacccgttaagtaccggaacccggaaggggaacctaaccggtacccctaaataccaaaactaacccgaacgtacccctaaagtaacgtacgggggtaaaccgttagggaacgaccggaaaggtccgtaggaagtacgtcgtacggaaccggaccggaccgggtccggttagttagtttacgttggtagacggagagttagtaagagttaaccttcttacgttacgttaaggttaacggggtttaaggg

SEQ ID NO: 350871 - DNA, 573 bp, Homo sapiens
  misc_feature: GZ8MTXP01EC66O.39.87.H10.1.454.CMB.2.raw
  modified_base (226)..(226): a, c, t, g, unknown or other
  misc_feature (226)..(226): n is a, c, g, or t
  modified_base (373)..(373): a, c, t, g, unknown or other
  misc_feature (373)..(373): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagcctggggcctnagtgagtctctgcaaggcttcgtggaactcaccctcaccgacgtctatatgctacgtggttcgacgacgacggcccctaggacaagggtcttggagtggagtgggactggatacgaaaccggtacaggtggtctacaaactaaattngacaacgagtaagttcgagggcagggtcacgatcgacgagggacacgtcagtacaactacagaccctaagagtacgggaactggacgacgaggtacgtagaacggtctacgtacggaaccggaacgtacgggttccgttagttagttgttaggttgaggagaagtagtgtaagttacttcttaaccgttaagtttaaggg

SEQ ID NO: 350872 - DNA, 518 bp, Homo sapiens
  misc_feature: GZ8MTXP01ELJ0L.39.87.H10.1.454.CMB.2.raw
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
  modified_base (423)..(423): a, c, t, g, unknown or other
  misc_feature (423)..(423): n is a, c, g, or t
  modified_base (482)..(482): a, c, t, g, unknown or other
  misc_feature (482)..(482): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacnggcccctggacaagggcttgagtggatgggatggatcaaccggtacagtggtctacaaacaaattntgacacagtaagtttcaggggtcagggtcaccatcgaccgaggacacgtcatacaatacagccanatggaactgagcaaggctagatatctagacgaacgacgggcctgttagttagttgttgngaggtaagatgagtacttcttcgttaagtttaaggg

SEQ ID NO: 350873 - DNA, 605 bp, Homo sapiens
  misc_feature: GZ8MTXP01CTWUO.39.87.H10.1.454.CMB.2.raw
  modified_base (347)..(347): a, c, t, g, unknown or other
  misc_feature (347)..(347): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagcctggtatcagcaagaaaccagggaaactcctaaggtcctgatctatgatgcctccagtttggaaagtggggtccatccaaggtcagcgcaagtgntctgggacagattcactctcacatcaccagcctgccggctagaacgtatttgactaactttattactgtaccaaacgtagttaattaaacttttactttaccccgtaacttaccgtttttcgggaacccgtaagggggtaacccctaaaggttccgttacgggacgtaaaccgtccgttaaaaaaccggaaccgttgggttaaccgggtaccgtttcgggacccgaacccgttaacgttcccctttaaggttttcccc

SEQ ID NO: 350874 - DNA, 606 bp, Homo sapiens
  misc_feature: GZ8MTXP01BBIGS.39.87.H10.1.454.CMB.2.raw
  modified_base (198)..(198): a, c, t, g, unknown or other
  misc_feature (198)..(198): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccgggcaagtcagggacaattaaaatgtattagctaggtatcagacaagaaaccgaagggaaaactcctaaggtcctagatactatgactcgccttacgtaggtttaggaaacggtcggggtacccagtacgtaaaggttcccaggcggacgtaggtcggtaatcgtggggaactagtactttcactctacaccatccaccacgccgtcggcggtactagtaacgttactttagacttaacttagttactagtaactaaacttaatttaacttctactccgtcttacgtacgttcgggacggacgggtaacctaagggtagaagtaacttaaacgaaaacggtacgttgttggctaacgactaacctattccgttacgtcttcgtaacc

SEQ ID NO: 350875 - DNA, 632 bp, Homo sapiens
  misc_feature: GZ8MTXP01D2XUH.39.87.H10.1.454.CMB.2.raw
  modified_base (246)..(246): a, c, t, g, unknown or other
  misc_feature (246)..(246): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctgggtgcagtccgggatgaggtgaagagcgtggggcctcagtgagtctcctgcaaggcttcnggaactcaccctcaccgacgtctatatgcactggtgcgacacggcccctggacaagggctgagtggagtgggatggatacgaacggtaaccaggtggtactacaacgtaaaaaattatgaccaacgtaaagggtaaacggttttacggaagggggacgtaacgggggtaccaaaccgtacgtacgggaaccgaaggggaacccgtaaccggtaccaaataccaaacgtaacaacgtaccctaaacgaaggtaagggaacctggaacgcgaaggcgtaggaagacgtcgtacgacgacgaacggtcccgttagttaagtttagttggtcggacgaggttaagtaagtagtaacgtttactctttacgtaacgttaagtttaaggggg

SEQ ID NO: 350876 - DNA, 539 bp, Homo sapiens
  misc_feature: GZ8MTXP01A6JZC.39.87.H10.1.454.CMB.2.raw
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (457)..(457): a, c, t, g, unknown or other
  misc_feature (457)..(457): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggtcttcgtggaactcgacccctcacccgacgtctatatgctacgtggttgccgacacggcccctggaccaagggcttggagtggagtgggatggatcgaaacggtacaggtgtctanaaacaattntgacacagtagttcgaggcaggtcacatgaccaggacacgtcagtacaatacagcctagagtagaactgagcgaggctagagtntcgtacgacgaacgacggttccgtagttagttagttgttgcgaggtaagagtgtacgtacttcttaacgttaagtttaaggg

SEQ ID NO: 350877 - DNA, 545 bp, Homo sapiens
  misc_feature: GZ8MTXP01DEQX9.39.87.H10.1.454.CMB.2.raw
  modified_base (359)..(359): a, c, t, g, unknown or other
  misc_feature (359)..(359): n is a, c, g, or t
  modified_base (512)..(512): a, c, t, g, unknown or other
  misc_feature (512)..(512): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagaagcctggggcctcagtgaaggtctcctgcaaggcttctggaatcaccctcaccgacgtctatatgcactggttgcgacaggcccctggacaagggcttgagtggatgggatggatcaaacggtaacagtggtctcaaacaaatttaangacaacgaagtaagtttcgagggacgaggtacaacagtacgacgaacggaacgacgtacacacaactaacacgacctaacgtagtagtaacgtagagacgacgacgtagagtagtactacgacgaacgacggacgtagttagttagttgttgngagaagagtaagatacttacttcgttaagtaag

SEQ ID NO: 350878 - DNA, 572 bp, Homo sapiens
  misc_feature: GZ8MTXP01CDF8C.39.87.H10.1.454.CMB.2.raw
  modified_base (447)..(447): a, c, t, g, unknown or other
  misc_feature (447)..(447): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggtcttcgtggaactccaccctcaccgacgtctatatgcacgtggttgcgacacggcccctaggaacgaagggcttggagtggagtgggatggactacgaaaccggtacaggtggtacctacgaaaactaaattgtagacaaacgtagtaagtttcgaagggacagggtcaaccgagtcgaaccgagggaccacgtacaanacaatacgacgtacctagagtaggaactgagcgagcgtagagtatcgtacgacgaacgcggttccgttagttagtttagtgttagngaagngtagtgtagtcttcttaacgttaacgtttaaggg

SEQ ID NO: 350879 - DNA, 528 bp, Homo sapiens
  misc_feature: GZ8MTXP01B8W8J.39.87.H10.1.454.CMB.2.raw
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagcctggggcctcagtgaaggtctcctgcaaggcttctggaatcaccctcaccgacgctatatgcacgtggttgcgacaggcccctggacaagggcttgagtggatgggatggatcgaaacggtaacagtggtctacgaactaaattaatgcaacaagtaaagtttcgagggcaggggtcaccatcgacgaggacacgtccatacaatacagacctacataggggaactgagcgagctgagatctgacgacgacggctgttattagttgngngagttagattgagttaacttctcgttactaagttgggttaacgggg

SEQ ID NO: 350880 - DNA, 567 bp, Homo sapiens
  misc_feature: GZ8MTXP01BMDSQ.39.87.H10.1.454.CMB.2.raw
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (528)..(528): a, c, t, g, unknown or other
  misc_feature (528)..(528): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtggggcctnagtgaggtctcctgcaaggcttcnggaatcaccctcaccgacgtctatatgcactggttgcgacgacggcccctggacgagggcttggagtggagtgggatggatacgaacggtaaccaggtggtctacacgtaaaaattatgacaacgtaaggtaagtttcgaggggtcaacggggtacaccgagtcgaccgaagggaccacgtaccaataccaaatacgacgtacctaacgaggtaggaacgtggaacgcgaggctaggaagtctcgtacggacgacgaacggtcgttaggtattagtgtagngagagtaatgtaacgtactcttactaagttaagttgggg

SEQ ID NO: 350881 - DNA, 655 bp, Homo sapiens
  misc_feature: GZ8MTXP01BJYBW.39.87.H10.1.454.CMB.2.raw
  modified_base (257)..(257): a, c, t, g, unknown or other
  misc_feature (257)..(257): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttggccggcaagtcagggcaattaaaatgtatttagcctggtancagacagaaaccagggaaaactcctaaggtcctagatctatgatcgcctccgtagtttaggaaacggttcggggtacccagtcgtaaaggttccgaacggtcggacgtaggtggaaacttccggtggggaactaacggtattttaccaaccttctaccaaccctatacccaacccgagccccgttggacccgggtacctaaggtaaagttacttttgaacctaaactttattaccgtagttactaaaacttaatttaaacttcttaactcccgtattaccgtacgtttcggggacgaacgggaccgtaaagggtgaacgtaagttaccgaaaacggtacttagggttcggacttaacggcctaacctagttcccgttagttaaccctttcgtaacccg

SEQ ID NO: 350882 - DNA, 629 bp, Homo sapiens
  misc_feature: GZ8MTXP01EVCIH.39.87.H10.1.454.CMB.2.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
  modified_base (543)..(543): a, c, t, g, unknown or other
  misc_feature (543)..(543): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcagtgaaggtctcctgcaggcttcnggaatccaccctcacccgacgtctatatgcactggtgcgacacggccccccgganaagggcttgagtggagtggggagtggatacgaaacggtaacgaggtcggtctacgaactaaattatagacaacgaaggtaagggtttcgggggacgacggggtcaaccgagtacggaaccgaagggggaccaaccggttacccaattaccaaattaaccacggtacccttaacaattacggggaaccttaggggagacgaggtacgtagacggatcgtaggacgacgtaccggccggttntaagtttattggtgacggaagagaagttggaacgttctctttaacgttacgtaggttaggggtttaaccggggttaagttttaaag

SEQ ID NO: 350883 - DNA, 587 bp, Homo sapiens
  misc_feature: GZ8MTXP01C5RRQ.39.87.H10.1.454.CMB.2.raw
  modified_base (252)..(252): a, c, t, g, unknown or other
  misc_feature (252)..(252): n is a, c, g, or t
  modified_base (483)..(483): a, c, t, g, unknown or other
  misc_feature (483)..(483): n is a, c, g, or t
  modified_base (536)..(536): a, c, t, g, unknown or other
  misc_feature (536)..(536): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagacgccgtggggcctcgagtgaggtctcctgcaggcttcnggatcaccctcaccgacgtctatatcgctacgtggttgccggtacgacgggccccctagggaaccgaaagggggtcgttaggaggtgggagtgggggatggaatcgaaacggtaacaggttggtctacgaactaaaaattatgacaacgtaggtaagtttcgagggcagggtacacagtcgacgaggacacgtcatacaatacagacctaacagtaggaacgtgacgacgngcgtgaacgtgtcgtgaacgacgaacggtccgttagttagttagtgtcggagngttaagtaagtagtaacgttactcgttacttaacgttaaggtttaaggggg

SEQ ID NO: 350884 - DNA, 518 bp, Homo sapiens
  misc_feature: GZ8MTXP01BVDUV.39.87.H10.1.454.CMB.2.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (326)..(326): a, c, t, g, unknown or other
  misc_feature (326)..(326): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagatcaccatcacttgcggnaagtcagggcaattaaaangattagctggtancagcaagaaacaggaaactcctaaggtcctgatctatgatgcctcagtttggaagtggtccatcaggtcagcggnagtgaatcgtgggacagtattcactctcacatcacagctgcgactagaagtatttgactaattattactggttactaacttaatttaattcttatccgtacttactacgtttcggacggtacggacgaaggtgagtacttacgaaacgtgttcgttggcctcgacaacctatccgttactcctttcgtaacc

SEQ ID NO: 350885 - DNA, 531 bp, Homo sapiens
  misc_feature: GZ8MTXP01DL6WJ.39.87.H10.1.454.CMB.2.raw
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggttgcgacaggcccctggacaagggcttgagtggatgggatggatcgaaacggtaacagtggtactcgaactaaattaatagcaacagtaaagtttcgaagggcaggggtcaccatgaccgagggacacgtacatcaatacagcctaanactaggggaaactgagcgaggctganatctagacgacncggctagttattattgtgngagttgatgaagtaacttcttcgttacttaagttcgggtttaagggg

SEQ ID NO: 350886 - DNA, 668 bp, Homo sapiens
  misc_feature: GZ8MTXP01C6I61.39.87.H10.1.454.CMB.2.raw
  modified_base (227)..(227): a, c, t, g, unknown or other
  misc_feature (227)..(227): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttggccgggnaagtcagggactaattaaaatgtatttagctggtatcagacaagaaaccaagggaaaactccgtaaaggtcctagactctatagatcgaccctttacgaaggttttaggaaaacggttcggggtaccctaagttacccgtaaaacgggtttcgaacggtccgggaccgtaaagggttcgggtaacgttaccggtagggggaaacctaacggttaacttttaccaaccttcctacccaacctacttacccaacccgacgtcccgtaggcccggtacctaggtaagttacttttacgaacttaaactttattacgtagttaactaaacttaattttaacttcttaatccgcttacgtacgttcgggacgggaacggaaccgagggtacgagtaactacgaaacgttcgttggtaacggctcgaccaccttagtccttgttccc

SEQ ID NO: 350887 - DNA, 749 bp, Homo sapiens
  misc_feature: GZ8MTXP01APD2W.39.87.H10.1.454.CMB.2.raw
  modified_base (229)..(229): a, c, t, g, unknown or other
  misc_feature (229)..(229): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttcgacccagtcctccatcctcctgtctgcatctgtaggagacagatcaccatcacgttggccggganaagtcgagggactaaattaaaatgtaatttagccgtaggtatcaagacaagaaaccgaagggtaaaacctccgtaaaggtcctagacttctatgatcgccttacgtaggtttaggaaacggtcggggtaccctaagtaccgtaaggttcaaggcggacgtaagggttaggtaatcggtaggggaactaggtactttcacttcctacacctatacccgaccctagcccgtaggccggtaccttaaggtaaacgttacgttttacggaaacctttaaaccgttttacgtttaacccgttaagttaaacccttaaaactttaaattttttaacctttacccgtttaaacgttccccggtactttacccgttaccgggttttacccgggggaccgggggttaaaccggggtaaaccggttaaaggggttacggggaaactaaaccgttaaccgttaaaaaccggttggttcgggttaacgggccttaacggaccctaaccttacgtttcccgttaacgtttccc

SEQ ID NO: 350888 - DNA, 624 bp, Homo sapiens
  misc_feature: GZ8MTXP01CIHDU.39.87.H10.1.454.CMB.2.raw
  modified_base (226)..(226): a, c, t, g, unknown or other
  misc_feature (226)..(226): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggacaattaaaatgatttagcctggtatcagacaagaaaccaagggaaaactccgtaaggtcctagatctatgatcgcccttacgtaggtttaggaaagtcggggtaccccagtacccgaagggttcaaggtcggacgtaaagggtgggaactcgtaggggaactagtactttcactcctacaccatccacacgcctaggccgtctagaagtctttacgacttaacttagttactagtactaaacttatttaactcttaactccgtacttccgtacgtttcgggcgggtaacgggtaaccgaaggggttacggaagtaaacgtaccgttaaaacggttacgttacgggttcggaccttcggaccctaaccgttacttccgttgtttaaccc

SEQ ID NO: 350889 - DNA, 558 bp, Homo sapiens
  misc_feature: GZ8MTXP01AOQLV.39.87.H10.1.454.CMB.2.raw
  modified_base (366)..(366): a, c, t, g, unknown or other
  misc_feature (366)..(366): n is a, c, g, or t
  modified_base (523)..(523): a, c, t, g, unknown or other
  misc_feature (523)..(523): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcgagtgaaggtctcctgcaaggcttctggaatcaccctcaccgacgtctatatgcacgtggttgcgacgacggcccctggacgaagggcttgagtggatgggatggatcgaaaccggtacagtggtctacgaaacaaattntagaccacagtaagtttcgagggcgacgggtcaccgatcgaccgaggggaccacgtcagtacaaactacacgtaccctagagtacggaactagaaggccgaggcgtagaaggcgtacgtacggagaacgtaacggccgttgttagttaggtattggngaggaagatgacgtattccttaattaacgttaagg

SEQ ID NO: 350890 - DNA, 610 bp, Homo sapiens
  misc_feature: GZ8MTXP01CQTDR.39.87.H10.1.454.CMB.2.raw
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttggccgggacaagtcagggactaaattaaaatgtatttagcctggtatcagacaagaaaccaagggaaaactccgtaaaggtcctagatactatgatcgtcccttacgtaggtttaggaaacggttcggggtacccagtacccgtaaggttcaggcggacaaggttggaatcgtaggggaactagtatttcactctacaccatccacagccctgccggtactagtaagtatttgacttaacttattaccgtataactaaacttaaatttacttacgttactcccgtcttcctaacgtttccgggacgggtaacgggtaaccgaaggggttagacgtaactaacgaaaaccgttgttcggtaaggctcgaccaccttagttcttcgtttaacc

SEQ ID NO: 350891 - DNA, 598 bp, Homo sapiens
  misc_feature: GZ8MTXP01ESMNQ.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcacccgacgtctatatgcacgtggtgcgacacggcccctggacaagggcttggagtggagtggatgtatccgaaccccgagacgtcggacgaacaacaaaataatgcaacaagagtatttacgaggggctaagggtccaaccgatcgacgtacgggacaccgtaccaactaacaaaacacgacctaaacgacgttaggggtaaactttcgaaaggtaacgaactaggaacgtaccgaaacgacgaaccggtacccgtagtacttcgtggttcgcgagacgggaccaggttacgttcccgaaggtggggtaataagggtgacgttaacgtttcggttaag

SEQ ID NO: 350892 - DNA, 512 bp, Homo sapiens
  misc_feature: GZ8MTXP01CV0E5.39.87.H10.1.454.CMB.2.raw
  modified_base (419)..(419): a, c, t, g, unknown or other
  misc_feature (419)..(419): n is a, c, g, or t
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacaggcccctggacaagggcttgagtggatgggatggatacgaacggtacagtggtactcaacaaattaatgcacagaaagtttcgaggggcagggtcaccatcgacgagggacacgtcatacaatacagcctanatggggaactgacgcgagcgtagaggactcgtagacgacgcggcgtgttattattgagnagngatgagtaactctacttatgttggttaaggg

SEQ ID NO: 350893 - DNA, 503 bp, Homo sapiens
  misc_feature: GZ8MTXP01BP851.39.87.H10.1.454.CMB.2.raw
  modified_base (356)..(356): a, c, t, g, unknown or other
  misc_feature (356)..(356): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaacggtacagtggtctcaacaaattntgcacagaagtttcgagggcaggggtcaccatgaccagggacacgtcatcaatacagcctacgataggaactgagcaggctgagatctgacgcaacgggccgtgttattagttgngcgagngatgagtacttcttcgttcgttaagg

SEQ ID NO: 350894 - DNA, 696 bp, Homo sapiens
  misc_feature: GZ8MTXP01BEHKI.39.87.H10.1.454.CMB.2.raw
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttcgacccagtctccatcctcctgtctgcatctgtaggagacagagtcaccatcacgttggccgggacaagtcagggacaattaaaatgattagctggtatcagacaagaaaccgaggaaactccgtaaggtcctagatctatgatcgccctacgtaggttaggaaaggtcgggtacccagtaccgtaaggttcaggcggacgtaaggtagggaagttcggtaggggtaactaggtaacttttccacttacctaccaacctatacccgaaaccgcgtcccgtacggccgggtaccttaggtaaacggttactttttacggaaaccttaaacgttttaacgtttaacgttacgttaaaccttaaactttaaacgtttttaaactttcctttaaactccccgttacttaccgttaccggtttcgggggacccggtaaaggggtacccgttaaaggggttacggaataacgttaaccgaaaacggttcgttacgggtgtaccggtcgacccctaaccttagttccttaacggtttccc

SEQ ID NO: 350895 - DNA, 568 bp, Homo sapiens
  misc_feature: GZ8MTXP01AVOBD.39.87.H10.1.454.CMB.2.raw
  modified_base (251)..(251): a, c, t, g, unknown or other
  misc_feature (251)..(251): n is a, c, g, or t
  modified_base (370)..(370): a, c, t, g, unknown or other
  misc_feature (370)..(370): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagaagccgtggggcctcagtgaaggtctcctgcaaggcttcnggaatccaccctcaccgacgtctatatgcacgtggttgcgacacggcccctggacgaagggcttggagtggagtgggatggatacgaaaccggtacaggtggtactacaaactaaattntgacaactaaggtaacgtttcgagggacgtagggtaccaccgagtcgaaccgaggggaccacgtccaatacaatacacgacctacgagtaggaactgagcgaggactagagtactacgagaccgaacgcggttcgtagttattagttggttacgcgttagaagacgtgtaacgtcttacttaaccgttaagttaaggg

SEQ ID NO: 350896 - DNA, 528 bp, Homo sapiens
  misc_feature: GZ8MTXP01CBKG2.39.87.H10.1.454.CMB.2.raw
  modified_base (255)..(255): a, c, t, g, unknown or other
  misc_feature (255)..(255): n is a, c, g, or t
  modified_base (399)..(399): a, c, t, g, unknown or other
  misc_feature (399)..(399): n is a, c, g, or t
  modified_base (512)..(512): a, c, t, g, unknown or other
  misc_feature (512)..(512): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagcctggtancagcaagaaaccagggaaaactcctaaggtcctgatctatgatgcctcagtttggaaagtggggtcccatcaaggttccaggcggcagtggaatcgtggggactagtatttcactctcaccatcacagcctgcggcctgaagtntttgactaacttatactgtactaaactaatttaattcttatccgcttactacgtttcgggcggagggaccaaagggtggaagattcgaaacgacttggttcggctgctaaccntcttgtcttcgtaacc

SEQ ID NO: 350897 - DNA, 619 bp, Homo sapiens
  misc_feature: GZ8MTXP01EA3FB.39.87.H10.1.454.CMB.2.raw
  modified_base (239)..(239): a, c, t, g, unknown or other
  misc_feature (239)..(239): n is a, c, g, or t
  modified_base (375)..(375): a, c, t, g, unknown or other
  misc_feature (375)..(375): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtgggcctcagtgaggtctctgcagctntggaactccaccctcaccgacgtctatatgactacgtggttcgcgacgacggcccccgtaggacgaaggggtcttaggaggtggagtggggatggatacgaaacggtaacaggtggtactacgaactaaatttaangaacaacgaaggtaaagtttcggaggggacgagggtaccaaccgatacggaccgacgggacacgtaccatacaaatacacgacctaacgagtacggggaactggaacgacgaggtctaggaagtacgttcgtacggaccgacgaaccgggtcgttagttagttagttggtacggacggagagttacgtaagttaacgttaacctttcgttacgttacgttaaggtttaacgggggtttaacggg

SEQ ID NO: 350898 - DNA, 601 bp, Homo sapiens
  misc_feature: GZ8MTXP01B0E24.39.87.H10.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatccctccctgtctgcatctgtagganacagagtcaccatcacttgccgggnaagtcagggcaattaaaaatgtatttagctggtancagcaagaaaccagggaaaactcctaaggtcctagatctatgatgcctcgagtttggaaaggtcgggtacccagtcgaaggttccaggtcggacgagtggaatcgtgggactagtacttcactctacaccatcacagcctgcgcctagaagtatttgactaacttattactagtactaaacttaatttaacttcttactcccgtacttaccgtacgtttccgggggacggtaacggggtaaccgtaaaggggttggaaacgtaacttaaccgaaaacggtaacgttcgggttgggttacttcggacctaacccgtattccgttgtttcccttcgttaacccg

SEQ ID NO: 350899 - DNA, 585 bp, Homo sapiens
  misc_feature: GZ8MTXP01BUMBI.39.87.H10.1.454.CMB.2.raw
  modified_base (359)..(359): a, c, t, g, unknown or other
  misc_feature (359)..(359): n is a, c, g, or t
  modified_base (539)..(539): a, c, t, g, unknown or other
  misc_feature (539)..(539): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaggtctcctgcaaggcttctggaatcaccctcaccgacgtctatatgcactggttgcgacacggcccctggacaagggcttgagtggatgggatggatcgaacggtacagtggtctacgaaactaaattntagacaacgtagtaagtttcgaggggcagggtcaaccgatacgaccgagggaaccacgtaccaatacaaactacaacgtacccttaacgaattacggggaaacctggaacgccgaagggctaggaagtaatccgtacgacggaacgaccgggttccgttagttagtttaagttggttagngttaaggaagtatggtaaacgttcttacttccgttaacgttaaggg

SEQ ID NO: 350900 - DNA, 606 bp, Homo sapiens
  misc_feature: GZ8MTXP01ETLOA.39.87.H10.1.454.CMB.2.raw
  modified_base (546)..(546): a, c, t, g, unknown or other
  misc_feature (546)..(546): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcacgtggttgcgacacggcccctggacaagggcttgagtggatgggatggatcgaaacggtacaggtggtactacgaactaaattatgcaacgaggtaaacgttttcgaagggggtccaaggggttccaacccgagtacggacccgaaggggaccaccggttacccaattaccaaataaccacgaccctaacagttacgggggaactggaacgccgaaggcgtagaagtaacgtcgtaggaccgacgacgggccgttagttattagtttggngacgaggagttagtaagtagttaaccttcgtttaccacgttaagtttgggtttaacgggg

SEQ ID NO: 350901 - DNA, 601 bp, Homo sapiens
  misc_feature: GZ8MTXP01BHFQ7.39.87.H10.1.454.CMB.2.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (366)..(366): a, c, t, g, unknown or other
  misc_feature (366)..(366): n is a, c, g, or t
  modified_base (397)..(397): a, c, t, g, unknown or other
  misc_feature (397)..(397): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggnaagtcagggcaattaaaatgattagctggtancagcaagaaaccgaggaaactccgtaaggtcctagatctatggatcgcctcgtaggtttaggaaacggtcgggtacccagtacgtaaggttccaggcggacaggtggaatcgngggactagtacttcactctacaccatcaccncgcctggcggtacctagtaagtctttagacttaactttattacgtagttaaccttaaattaattttacttaccgttactcccgtcttaccgtacggtttccggggacgggtaacgggaccgtaagggtacggataacgttaaccgaaaacggtgttcgggttcgctaacgacctaaccgttattcgttacgttcttcccgtaac

SEQ ID NO: 350902 - DNA, 764 bp, Homo sapiens
  misc_feature: GZ8MTXP01CN1RC.39.87.H10.1.454.CMB.2.raw
  modified_base (258)..(258): a, c, t, g, unknown or other
  misc_feature (258)..(258): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccggcaagtcgagggactaattaaaatgtatttagctggtancagacaagaaacaacgggaaactccgtaaggtcctagatctagtgacttcgcccttacgtaaggttttacgggaaacggttcgggggtacccctaagtaccggtaaacggtttcccgaacggtcgggtacgtaagggtcggtaaacgttccggttaaggggaacctaagttacttttaccaccttacctaccaaccctacttacccgaacccgtaacggtccccgttagggacccgggttaccgtttaagggtaaacgtttaccgtttttaacggaaccctttaaaaccttttaagtttaaccctttaggggttaaccctttaaaaacgttttaacttttaaactttacctttaaaccgtcccgttacttaccgttaccggtttaccggggacgggtaaacgggtaacccgaaaggggttcggaaacgttaacaaacggtaaacgtcgttacgggttcgaccgttaacgccctaaccgtcttcttaccgtttcttaaccgttcccg

SEQ ID NO: 350903 - DNA, 566 bp, Homo sapiens
  misc_feature: GZ8MTXP01DV99X.39.87.H10.1.454.CMB.2.raw
  modified_base (337)..(337): a, c, t, g, unknown or other
  misc_feature (337)..(337): n is a, c, g, or t
  modified_base (472)..(472): a, c, t, g, unknown or other
  misc_feature (472)..(472): n is a, c, g, or t
  modified_base (510)..(510): a, c, t, g, unknown or other
  misc_feature (510)..(510): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagctggggcctcagtgagtctcctgcaaggcttctggaatcaccctcacccgacgtctatatgcactggttgcgacaggcccctggacaagggtcttggagtggatgggatggatcgaacggtacnggtggtctacaactaaaattgtgacacgaagtaacggtttcgaaggggtcgagggtaccaccgtatcggaaccgaggacaacgtccatacaatacagtacctacaagtacggaaactgacgcgagcgtagaagtntcgtagacggtacgaacggtcgttgttacttagttggngacgttggaagtaagttagaacgtttactctttacctaagttaaggtttaaggggg

SEQ ID NO: 350904 - DNA, 698 bp, Homo sapiens
  misc_feature: GZ8MTXP01DEGAE.39.87.H10.1.454.CMB.2.raw
  modified_base (225)..(225): a, c, t, g, unknown or other
  misc_feature (225)..(225): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccgggnaagtcagggacaattaaaatgtattagctggtatcagacaagaaaccagggaaaactcctaaaggtcctagatctatgatcgccttcaggtttaggaaagtcggggtaccatccgaaggttcaggcggacaacggtggtcgtcgtagggactaggtactttcaacgtcccttccaaccctacgttaccaacccgacgccccgttggacccgggtacctaaggtaaacggttacttttacggaaccttaaacttttaatttaacccgttagttaaacctaaactttaaactttttaaactttccgtttaacgttaccccggtctttacccgttaacccggtttcgggggtaaccggggtaaacggggtaacccgaaagggggtttcggaaacgttaaaccgtaacgttaaaaaccggttacgttagggtaaccgggtctcggaccctaccttaacttccgtttcgtttaacccc

SEQ ID NO: 350905 - DNA, 533 bp, Homo sapiens
  misc_feature: GZ8MTXP01CNLKX.39.87.H10.1.454.CMB.2.raw
  modified_base (364)..(364): a, c, t, g, unknown or other
  misc_feature (364)..(364): n is a, c, g, or t
  modified_base (478)..(478): a, c, t, g, unknown or other
  misc_feature (478)..(478): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcacgtggttgcgacaggcccctggacaagggcttgagtggatggatggatcgaaaccggtacagtggtactacgaaactaaattntgaccacgaagtaagtttcgaagggacaggggtcaccgatggaccagggacacgtccatacaatacagacctacagtggaactggagcgaggtcagagtgtacacgacgaaccncggttcgtgttagttagttgnggngagtgatggtatacttcttcttaagttaagg

SEQ ID NO: 350906 - DNA, 568 bp, Homo sapiens
  misc_feature: GZ8MTXP01CVY00.39.87.H10.1.454.CMB.2.raw
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (446)..(446): a, c, t, g, unknown or other
  misc_feature (446)..(446): n is a, c, g, or t
  modified_base (468)..(468): a, c, t, g, unknown or other
  misc_feature (468)..(468): n is a, c, g, or t
  modified_base (518)..(518): a, c, t, g, unknown or other
  misc_feature (518)..(518): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagagccgtgggcctcgagtgaaggtctcctgcaaggcttcaggactccaccctcacccgacgtctatatcgctacgtggtcgcgacacggcccctggaccgagggtcttggagtggagtggatggatacgaaacgtacngtggtctacgaataaattaangcaacgtaagtaacgtttcgaggtcgaggtacacgatacgacgagggactacgaccatacaaacgtacacgacctaanacgtacggaacgtagagcgagngagagtactcgtagacgacgcggtaacgtagttattagttgtacgagagngttacgtaagtacttaacgttctacgttacgttggttaagggtttaaggg

SEQ ID NO: 350907 - DNA, 623 bp, Homo sapiens
  misc_feature: GZ8MTXP01EOAD9.39.87.H10.1.454.CMB.2.raw
  modified_base (251)..(251): a, c, t, g, unknown or other
  misc_feature (251)..(251): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcgagtgaaggtctctgcaggcttnggactcaccctcaccgacgtctatatgcacgtggttgcgacacggccccgtggacgaaggcttgagtggagtgggatggatacgaacggtacaggtgtctacaaacaaattgtgacaacgagtaacggtttcgaacggggtcacgggtacaacctagtacgaaccgaggggaaccaccgttaccaactactaaacgtaacaacgtaccctaacgtacggttaaggaaaccgtacggagccgaagggcctaggagtaactccgtaggaaccgaacgtaaccgggccggttagttaagtttagtttggcggttcggaagtaaggtaagttaaggtaacggttaccttacgtttaaccgttaacgttttaagggg

SEQ ID NO: 350908 - DNA, 560 bp, Homo sapiens
  misc_feature: GZ8MTXP01AO4J6.39.87.H10.1.454.CMB.2.raw
  modified_base (369)..(369): a, c, t, g, unknown or other
  misc_feature (369)..(369): n is a, c, g, or t
  modified_base (425)..(425): a, c, t, g, unknown or other
  misc_feature (425)..(425): n is a, c, g, or t
  modified_base (469)..(469): a, c, t, g, unknown or other
  misc_feature (469)..(469): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctctgcaaggcttctggaatcaccctcacccgacgtctatatgctactggttgcgacacggcccctaggacgaaggcttagaggtggagtgggatggatacgaaacggtaacaggtggtactacgaacaaattaanagcaacagaaagtttcgagggtcgagggtacacatcgaccgagggacacgacgtanacaatacagacctacgataggggaactgagcgagcgtagagacncgtagacgacgcgtctggttattgttggtgtacgagagttagtaagtaggttaacttcgttaccgttacgttgttaagggtttaaccgggg

SEQ ID NO: 350909 - DNA, 597 bp, Homo sapiens
  misc_feature: GZ8MTXP01C816E.39.87.H10.1.454.CMB.2.raw
  modified_base (251)..(251): a, c, t, g, unknown or other
  misc_feature (251)..(251): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccggactggaggtgaagaagccgtggggcctcgagtgaaggtctctgcaaggcttcnggaactcaccctcaccgacgtctatatgcacgtggtgcgacacggcccctggacaggcttggagtgagtgggatggatacgaacggtaaccaggtggtactacaactaaaaattatgacaaacgtaagggtaaacgtttcgaacgggggtacaacggggtacaaccgagtacggaacccgaagggaaccaaccggttaccaactacaaactacaacgacctaaccagtacggtaacgtagaacggacaaggctaggaatacgtcgtagaccgaacgtaacggtcgttagtagttagttgtgagttagagtaatagtgttactcgttactaagttaaggttaagggg

SEQ ID NO: 350910 - DNA, 509 bp, Homo sapiens
  misc_feature: GZ8MTXP01BQ7XM.39.87.H10.1.454.CMB.2.raw
  modified_base (360)..(360): a, c, t, g, unknown or other
  misc_feature (360)..(360): n is a, c, g, or t
  modified_base (483)..(483): a, c, t, g, unknown or other
  misc_feature (483)..(483): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggatgggatggatcgaaccggtaacagtggtctcaaacaaattntgcaacagtagtttcgagggcagggtcacgatgaccgagggacacgtccatcaatacagcctacgatggaactgagcgaggctagagatctgacgaacacggcgtgttattagtgttgcgagngatgagtacttcttcgttcgttaagg

SEQ ID NO: 350911 - DNA, 559 bp, Homo sapiens
  misc_feature: GZ8MTXP01BDW9U.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatccaccctcacccgacgtctatatgcacgtggttgcgacacggcccctggacaagggcttggagtggagtgggatggatcgaaaccggtacaggtggtctacgaaactaaattgtgacacgaggtaagtttacgaggggtacagggtcacgatcgaaccgagggaccacgtaccagtacaatacacgtacctacgagttaggaacctggaacgccgaggctaggagtatcgtagacgaacgcggttcgtgttagttgtgttcgcgagaagtagtggacgttcttcttaacgttcgtttaaggg

SEQ ID NO: 350912 - DNA, 566 bp, Homo sapiens
  misc_feature: GZ8MTXP01AYAIF.39.87.H10.1.454.CMB.2.raw
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggatacatcttcagcgcctattatatacactggtgcgccacggcccctggacagggcctgacgtggagtgggatgtatacgaaccccgagaggtggacgaacaacaaaaaatatgcaacgagagtatttcgagggacacgggtcaccagtgacgtcgggaacacgtaccataccaaaacacgtacctaacacgtaggtaattacgagttagactagaacgtaccaaacgaccgacggtccgtaggtaacttcgttgtcgnggaagcggacgngttacgttccgacggtgggatagttcgtaacgttaagttttaacgg

SEQ ID NO: 350913 - DNA, 523 bp, Homo sapiens
  misc_feature: GZ8MTXP01A744Y.39.87.H10.1.454.CMB.2.raw
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (498)..(498): a, c, t, g, unknown or other
  misc_feature (498)..(498): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagccgtggggcctcagtgaaggtctcctgcaaggcttctggaatcaccctcaccgacgtctatatgcactggttgcgacacggcccctggacaagggcttgagtggatggatggatcgaaaccggtacagtgtctcaaacaaattntgacanagtaagttcgagggcagggtacaccgatacgaccgagggacacgtccatacaatacagcctacgagtaggaactgagcgagctgagtatcgcgacgaacgacggccgtagttattagttaggttgcggagaagntgagtacttcttcgttaagttaagg

SEQ ID NO: 350914 - DNA, 638 bp, Homo sapiens
  misc_feature: GZ8MTXP01D04EX.39.87.H10.1.454.CMB.2.raw
  modified_base (330)..(330): a, c, t, g, unknown or other
  misc_feature (330)..(330): n is a, c, g, or t
  modified_base (580)..(580): a, c, t, g, unknown or other
  misc_feature (580)..(580): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctgggcctcagtgagtctctgcaggctctgatcacctcaccgacgtctatatgcactggttgcgacacggcccctggacaagggtcttagagtggatgggatggatcgaaacggtacngtggtactacgaactaaattatgctaacgtaagtaaacgttttccgaaggggtacaacgggggtccacccgtaagtcggaaccgagggaccaacggttaccaattacgaaacttacgacgtaccctaaagacgttacgggggaaaccttaggaacggtaccgtaacggtcgttacgtaagaacgtttcgacggtaacggtaccgtaacgggtcccgttagttaacgtttagtttggacgtacgttaaggngttagtggtacgttaaccttcgtttaccttaacggtttaagttcggggtttaacgggg

SEQ ID NO: 350915 - DNA, 521 bp, Homo sapiens
  misc_feature: GZ8MTXP01AOJLH.39.87.H10.1.454.CMB.2.raw
  modified_base (355)..(355): a, c, t, g, unknown or other
  misc_feature (355)..(355): n is a, c, g, or t
  modified_base (450)..(450): a, c, t, g, unknown or other
  misc_feature (450)..(450): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaggtctcctgcaaggcttctggaatcaccctcaccgacgtctatatgcactggttgcgacaggcccctggacaagggcttgagtggatgggatggatcaacggtacagtggtctcaaacaaattntgacacagtaagtttcagggcagggtacacgatgaccagggacacgtcatacaatacagacctacgactaggaacctgacgcgaggctagaggtntccgtagacgaacgtacggcgtagttattagttgttgcgagtaagatggagtacttcttcttaagttaagg

SEQ ID NO: 350916 - DNA, 577 bp, Homo sapiens
  misc_feature: GZ8MTXP01C7KQI.39.87.H10.1.454.CMB.2.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (347)..(347): a, c, t, g, unknown or other
  misc_feature (347)..(347): n is a, c, g, or t
  modified_base (470)..(470): a, c, t, g, unknown or other
  misc_feature (470)..(470): n is a, c, g, or t
  modified_base (532)..(532): a, c, t, g, unknown or other
  misc_feature (532)..(532): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcgagtgaaggtctcctgcaaggcttcgnggaactcaccctcaccgacgtctatatgcacgtggtgcgacncggcccctggacaagggcttaggagtggagtggatggatacgaacgtanagtgtacacaaactaattgagacaacgtaagtacgttacgagggacgtacggtacacgagtacgaccgtagggaccacgtacactacaactacacgtacctagagtacggaactagacgacgnggtacgtagacgtagtacacggaccgaacggacggttcggttagttacttaggtggttacgnggaaggtgtagtcgtacgtacttcttaacgttaacgtttaagggg

SEQ ID NO: 350917 - DNA, 513 bp, Homo sapiens
  misc_feature: GZ8MTXP01AMM7E.39.87.H10.1.454.CMB.2.raw
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagcctggggcctcagtgaaggtctcctgcaaggcttctggaatcaccctcaccgacgtctatangcactggttncgacacggcccctggacaggctgagtggatgggatggatcgaaacggtaacaggtggtctacgactaaaattntgcacgagtacgtttnagggcagggtcacatcgacgaggacacgtcatacaatcagcctanagtgaactgacgcgngcgtgagtactctagacgagaacgcgttatagttagtggtgngngagntacgaagttactcttcgtaagttgttaagggg

SEQ ID NO: 350918 - DNA, 545 bp, Homo sapiens
  misc_feature: GZ8MTXP01BC7YT.39.87.H10.1.454.CMB.2.raw
  modified_base (366)..(366): a, c, t, g, unknown or other
  misc_feature (366)..(366): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaggtctcctgcaaggcttctggaatccaccctcaccgacgtctatatgcactggttgcgacacggcccctggacaagggcttgaggtggagtgggatggatcgaaccggtaacaggtcggtctacgaaactaaattntagccaacgtagtaagtttcgaggggcagggtcaccagtcgaccgagggacacgtcatacaatacagcctagacttaggaactgacgcgaggctagagtagtcgtcggaacgaacgacggttccgtgttagttagtgttgcgagaagtagtgtagtacttcttaagttaacgttaaggg

SEQ ID NO: 350919 - DNA, 571 bp, Homo sapiens
  misc_feature: GZ8MTXP01BYSWJ.39.87.H10.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (373)..(373): a, c, t, g, unknown or other
  misc_feature (373)..(373): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggactaattaaaangtattagctggtatcagacaagaaaccagggaaactcctaaggtcctagatctatgatgcctacgtagtttaggaaacggtcggggtacccagtacgaagggttccaggcggacgaggtggaaattcgnggggactagtactttcactctacacctatcacagcctgcgtcctagaagtatttcgactaacttattactagtaactaaacttaatttaacttcttaacgtcccgactttaccgacgtttcgggaccgggtaaggaccgtaagggtgagacttacgaaaccgattgacggcctaagccaactatcttcgtccttctcc

SEQ ID NO: 350920 - DNA, 686 bp, Homo sapiens
  misc_feature: GZ8MTXP01DDSLF.39.87.H10.1.454.CMB.2.raw
  modified_base (649)..(649): a, c, t, g, unknown or other
  misc_feature (649)..(649): n is a, c, g, or t
  modified_base (658)..(658): a, c, t, g, unknown or other
  misc_feature (658)..(658): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgagtccgggactgaggtgaagaagcgtggggcctcgagtgaaggtctccgtgacgaaggtcttcgtaggaaactccacccctcgaaccccgtacgtacctatactcggcctacgttggttcgaccggaacgaccgggcccccgtaggggaaccgtaaagggggtcctttaggagggttggggaagttgggggataggggaataccggaaaccgggttaaccgtaggtcggtacctaacgaaaaacttaaaatttcgtagaccctaaagtaggtaaacggtttcgggaacggggtacgtaacggggttaccaacccgtaagtacggaaccgaaggggaacctacgtaccaagtacaaataccgacgtaccttaacgagttaaggaaccgagaacggcgacggtacgtaggaaggtctaccaggaccgaacgacggttcggtattagttagtggttagngagaagtanggtatacgttcttaagttaagttaaggg

SEQ ID NO: 350921 - DNA, 547 bp, Homo sapiens
  misc_feature: GZ8MTXP01B3LUO.39.87.H10.1.454.CMB.2.raw
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
  modified_base (427)..(427): a, c, t, g, unknown or other
  misc_feature (427)..(427): n is a, c, g, or t
  modified_base (463)..(463): a, c, t, g, unknown or other
  misc_feature (463)..(463): n is a, c, g, or t
  modified_base (509)..(509): a, c, t, g, unknown or other
  misc_feature (509)..(509): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcagtgaaggtctcctgcaaggtcttcgnggaactccaccctcaccgtacgtctatatcgcagtggtgcgacacggccccnggacgaggcttagagtggagtgggatggatacgaaacggtacagtcggtactacaaaacaaattntgacaacagtaacgttcgagggcaggtacacancggaacgaggacacgtacatanaaactacacgtacctagagtacggaactagagacgngcaggagactcgacgcgaacacggttcgttattagttaggtgacgngagaatgaagtacgtccttcttaagttaacgttaaggg

SEQ ID NO: 350922 - DNA, 582 bp, Homo sapiens
  misc_feature: GZ8MTXP01CSFOZ.39.87.H10.1.454.CMB.2.raw
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagctggtatcagcaagaaaccaggaaactcctaaggtcctgatctatgatgcctcgagtttaggaaagtcggggtccatccgaaggttcgagcggcgaagtggaatcgtagggactagtatttcactctacacactcaccagccgtaggccggtctagaagttatttgacttaactttattactacgtacaaacttaatttaacttcttactccgtcttaccgtacgtttccggggacgggtaacgggtaccgttaaaggggtcgaaacgtaacgttacaaaaacggttcgttaggtcgggcttcggaccaccttagttccttggtttaaccc

SEQ ID NO: 350923 - DNA, 664 bp, Homo sapiens
  misc_feature: GZ8MTXP01AU30U.39.87.H10.1.454.CMB.2.raw
  modified_base (220)..(220): a, c, t, g, unknown or other
  misc_feature (220)..(220): n is a, c, g, or t
  modified_base (254)..(254): a, c, t, g, unknown or other
  misc_feature (254)..(254): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccggnaagtcaggactaattaaaatgtattagctggtancagacaagaaaccagggaaactcgtaagtctagatctatgatcgcctcgtaggtttaggaaacggtcgggtacccagtacgtaaggttccaggcggacgaggtggaattcggtgggactaaggtactttaccgacttcctaccaacccacttacccaacccgacggtcccgtacgggcccgggtacccgttaggtaaacgttagttttacgaaccttaaactttaacgtttacttacggttaacctaaactttaaacttttaactttaccttaactcccgttactttacgtaccggttttccggggacgggtaacgggtaaccgtaagggtacggaacgtaacgttacgtaaaacggtacgttggttcggttctaacggacctaacgtactcttacgttccttcgtaacc

SEQ ID NO: 350924 - DNA, 547 bp, Homo sapiens
  misc_feature: GZ8MTXP01BTCXE.39.87.H10.1.454.CMB.2.raw
  modified_base (363)..(363): a, c, t, g, unknown or other
  misc_feature (363)..(363): n is a, c, g, or t
  modified_base (506)..(506): a, c, t, g, unknown or other
  misc_feature (506)..(506): n is a, c, g, or t
  modified_base (516)..(516): a, c, t, g, unknown or other
  misc_feature (516)..(516): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcactggttgcgacacggcccctggacaagggcttgagtggagtgggatggatcgaaaccggtacaggtggtctcaaacaaattntgacacgagtaagtttcgagggcagggtcaccatcgacagggacacgtcagtacaactacagacctacgaagttcgggaactgacgcgaggtcgtagaggacttcgcgaacggaacgacggccgtaggttattagtgttcggngttaggaagngtgtaggtcttacttccgttaagtttaaggg

SEQ ID NO: 350925 - DNA, 638 bp, Homo sapiens
  misc_feature: GZ8MTXP01B68WM.39.87.H10.1.454.CMB.2.raw
  modified_base (508)..(508): a, c, t, g, unknown or other
  misc_feature (508)..(508): n is a, c, g, or t
  modified_base (585)..(585): a, c, t, g, unknown or other
  misc_feature (585)..(585): n is a, c, g, or t
  modified_base (591)..(591): a, c, t, g, unknown or other
  misc_feature (591)..(591): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcgagtgaaggtcctcgtgacgagtctgagtactcccaccctaccgaccgtcgtactaatagtcgactacggttggttcggaccgaacggaccccggtccccggtaggaaacgggacgggttcgttaggtaggtaggtagggtggtaggtagtactaacggtaaacggtacgtaggtcggtactacgtaaactaaattaagtacaacctaaagtaaaggttaacgttacgggacgggtacggtacgggtaccacgtagaccggacgaggacctacgacactaactaanacgactacctaagtggtaacgggactaggacaggagtcagatactgacgacgacgcggtgtagttattgttggacgngagttnttagtaacgtacttcttactacttagttaaggttcggggtttaaagg

SEQ ID NO: 350926 - DNA, 775 bp, Homo sapiens
  misc_feature: GZ8MTXP01COBIH.39.87.H10.1.454.CMB.2.raw
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggnaagtcagggcaattaaaatgtatttagcctggtancagacaagaaaccgagggaaactccgtaaggtcctgatctatgatcgcctcgtaggtttaggaaaggttcgggtacccagtacgtaacggttccaggcggctaggtgggaattcgtggggaactaaggttacttttaccgaccttaccctaccaaccccgtacttacccaaccccgtacgggtccccgttagggaccccggggtaccctttaagggtaaaacggtttacgtttttttaccggaaccctttaaaactttttaactttaaccgtttacgggggtttaaacccttaaaaaccttttaaatttttttaaaccgtttacccttttaaaccgtcccccggttacctttacccgttaaccgggttttcccgggggaaccggggtaaacgggggtaaaccccgtaaagggggttaggaaacggtaacgttaaacccgtaaaaccggtacgttaggggttcggttaccgttaacggaccctaacccgtagtttccgttacgttccctttcgtaacccg

SEQ ID NO: 350927 - DNA, 607 bp, Homo sapiens
  misc_feature: GZ8MTXP01EIFZ0.39.87.H10.1.454.CMB.2.raw
  modified_base (259)..(259): a, c, t, g, unknown or other
  misc_feature (259)..(259): n is a, c, g, or t
tcagtcgcactagtcacgaccggtgctcgatttagcagtactgcgttgggtttgggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcacatcacttgccgggcaagtcagggactaaattaaaatgtattagctggtancagacaagaaacaggaaactccgtaagtcctagatctatgatcgcctacgtaggtttggaaaggtcgggtacccaagtacgaaggttccaggcggcaggtggaatcgtgggactagtactttcactctacaccataccaccagtcctacggccggtactagtaagttctttacgacttaaacttattactggtaactaaattaatttaacttcttactccgtacttacgtacggttcgggacgggtaacgggaaccgtaaagggtcggaagtaaacttaaacgtaaaacgtaacgttgggttcggaccttgacctaactacgttcttcttaaccttaacgttaacccg

SEQ ID NO: 350928 - DNA, 614 bp, Homo sapiens
  misc_feature: GZ8MTXP01BX6D4.39.87.H10.1.454.CMB.2.raw
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
  modified_base (549)..(549): a, c, t, g, unknown or other
  misc_feature (549)..(549): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggatgaggtgaagagccgtgggcctcgagtgagtctctgcaaggcttnggaatcaccctcacccgacgtctatatgcacgtggtgcgacgacggcccctggacaagggtcttggaggtggagtgggatggatacgaacggtaaccaggtggtctacgaactaaaaattntcgactaacgagtaaacgtttcgaacgggggctaacgggtcacagtagaccgaagggacacggtaccataccgaaattacaacgtacctaacgagtacggtaacctggaacgacgaacggcgtaggaacgtactacggtacgaccggtaacgaaccgggtcgtttagttaagtttagtggtacgnggttaagaggtaagttaggtaacgtttaccttacgtttaccgtaacgtttgggtttaaccggggg

SEQ ID NO: 350929 - DNA, 537 bp, Homo sapiens
  misc_feature: GZ8MTXP01BJ9S2.39.87.H10.1.454.CMB.2.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
  modified_base (398)..(398): a, c, t, g, unknown or other
  misc_feature (398)..(398): n is a, c, g, or t
  modified_base (520)..(520): a, c, t, g, unknown or other
  misc_feature (520)..(520): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcaattaaaangatttagctggtancagcagaaacaggaaactctaaggtcctgatctatgatgcctctagtttaggaaagtgggtccagtcaaggttccaggcggcagtggaatcgtgggacagtactttcactctacaccatcaccagcctgcggacctagaagtntttgactaacttattactagtactaaacttaatttaacttcttactccgtcttctacgtttcgggacggtacgggccgtaaggtggataacttacgaaaccgtagttgttggctgcaacctntcttcgtcttcgtaacc

SEQ ID NO: 350930 - DNA, 634 bp, Homo sapiens
  misc_feature: GZ8MTXP01DD992.39.87.H10.1.454.CMB.2.raw
  modified_base (353)..(353): a, c, t, g, unknown or other
  misc_feature (353)..(353): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatccaccctcaccgacgtctatatgcactggttgcgacacggccccctaggacaagggcttagagtggagtgggatggatcgaaacggtaacaggtggtctnaactaaattatgcacagtaagttcgagggcagggtcaccgatcgaccgagggacacgtacacgttacaaactacaacgtccctaaacgacgtacgggggaaactgggaaacgccgaaggggtaacccgttggaacggtaacgttccggtaggaacccgaaccggtaccgggtaaccggtttaggttaatttaacggttgggtacggacggttaagaggttaagttgggtaaatttccgttacttacgttacgtttaacgggttgggggttttaaacggggg

SEQ ID NO: 350931 - DNA, 651 bp, Homo sapiens
  misc_feature: GZ8MTXP01BQ2SX.39.87.H10.1.454.CMB.2.raw
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggatgaggtagaagagccgtggggcctcgagtgaagtctctgcaggcttngatcaccctcacgacgtctatntgctacgtggtcgccgacgacggcccccgtaggacgtaagggtcttaggaggtggagtgggagtggaatacgaacggtaacgaggttgtactacgaactaaaattagtgaccaaacgtaaggtaaacgtttacgaaggggtctaacggggtaccaaccgagtacgaaccgaagggaacctaaccggtactaataccaaatacgaacgacctaacgaggtaacggtaacgtggaacgacgacggtcgagaacggtacttacgacgaccggaacgtaacgggtccggttagtttaagttaagttcgggtaggttaaccgggaggaagtaacgtaggtaacttacgttacccgtttagttaaccgtttaagggttttaacggggg

SEQ ID NO: 350932 - DNA, 537 bp, Homo sapiens
  misc_feature: GZ8MTXP01BF0B6.39.87.H10.1.454.CMB.2.raw
  modified_base (247)..(247): a, c, t, g, unknown or other
  misc_feature (247)..(247): n is a, c, g, or t
  modified_base (417)..(417): a, c, t, g, unknown or other
  misc_feature (417)..(417): n is a, c, g, or t
  modified_base (497)..(497): a, c, t, g, unknown or other
  misc_feature (497)..(497): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagcctggggcctcagtgaaggtctcctgcaaggcttcnggaatcaccctcaccgacgctatatgcactggttgcgacacggcccctggacaagggcttgagtggatgggatgtatcaaccccgagacgtggcgacacaaaatatgcacagagatttcgagggcagggtcacatgactcgggacacggtccatacgaaacagacctaanactagggggaaatttccgaagttagactagaacgtaccaaacgacaccgggactgtacttctagttgacgagaggcaggngttacccaaggtgggaataagtgacgtaagtttcgtaagg

SEQ ID NO: 350933 - DNA, 654 bp, Homo sapiens
  misc_feature: GZ8MTXP01AP8ZP.39.87.H10.1.454.CMB.2.raw
  modified_base (197)..(197): a, c, t, g, unknown or other
  misc_feature (197)..(197): n is a, c, g, or t
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (634)..(634): a, c, t, g, unknown or other
  misc_feature (634)..(634): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcacatcacgttcggccggacaagtcgagggactaaattaaaangtattacgcgtggtancagacaacgaaaccgaaggaaacctccgtaacggtcctagtatctagtgactcgtcctacgtaggtttagggaaacgggtcgggtacctagtacgtaacggttccgacggcggtacgtaggtggaacttcgggtaagggaactaagttactttctaccttactaccaccctatacccaaccgacgtcccgtcgggcccggtacctaaggtaaacgtttcgttttacgaaccttaaactttacgttactacggttaaactaaactttaaactttacttcttaactccgtacttacgtaccggttcgggacgggtacggaccgtaaggtgaagtacaacgaaacgtagttcggttcgaccgtgacctaacgtntcgttacttccttaactccg

SEQ ID NO: 350934 - DNA, 541 bp, Homo sapiens
  misc_feature: GZ8MTXP01BIYMV.39.87.H10.1.454.CMB.2.raw
  modified_base (243)..(243): a, c, t, g, unknown or other
  misc_feature (243)..(243): n is a, c, g, or t
  modified_base (450)..(450): a, c, t, g, unknown or other
  misc_feature (450)..(450): n is a, c, g, or t
  modified_base (490)..(490): a, c, t, g, unknown or other
  misc_feature (490)..(490): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (521)..(521): a, c, t, g, unknown or other
  misc_feature (521)..(521): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgagtctcctgcaggcttcnggatccaccctcaccgacgtctatatgcacgtggtcgcgacacggcccctggacgaagggtcttagagtggagtgggatggactacgaaacggtacaggtcggtactacaactaaattatcgcaacgtaagtaacgtttcgaaggggtctaggggtccaacctagtacggaaccgagggaccacgtacatacaactacacgacctanagtacggggaactgacgcgagctagagactcgagacgacncggctgttattgttgtgngagnatggatctntcttagtgttcgggttaagg

SEQ ID NO: 350935 - DNA, 670 bp, Homo sapiens
  misc_feature: GZ8MTXP01DOD3E.39.87.H10.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccggnaagtcagggactaattaaaatgtattagctggtancagcaagaaaccgagggaaactccgtaagtcctagatctatgatcgcctacgtaggtttaggaaaggttcggggtacccaagtcgtaaacggttcacggtcggcgtaaggtggtaactacgtggggactaggtacttttccacctcgtaccaacctacttccaccgtagcccttcggaccgggtacctagggtaacgttattttacgacttaactttaatttacccttagggtttaaaccctaaatttaaacttttaactttaccttactaccgtaccttaccggtacgtttcgggggacgggtaacgggtaaccggtaaagggttcgggaaccgtaagttaaaccgtaaacggtacgttaggttcggttacgttcgaaccgaaccgttatcttcggttcctttaacgtaacc

SEQ ID NO: 350936 - DNA, 539 bp, Homo sapiens
  misc_feature: GZ8MTXP01APGK0.39.87.H10.1.454.CMB.2.raw
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
  modified_base (401)..(401): a, c, t, g, unknown or other
  misc_feature (401)..(401): n is a, c, g, or t
  modified_base (529)..(529): a, c, t, g, unknown or other
  misc_feature (529)..(529): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcaattaaaatgatttagcctggtancagacagaaaccagggaaactctaaggtcctgatctatgatgcctcagtttaggaaagtgggtccatcaaggttccaggcggcagtggaatcgtgggacaggtatttcactctcaccatacaccagcctgccggactaggaaatntttagactaacttattacctaggtactaaattatttaacttcttatccgtactcgtacgtttcggacgggtaggaccgaagggtgaagattacgaaacgtagttggttcgctgacaacctatccgttntccttctaac

SEQ ID NO: 350937 - DNA, 757 bp, Homo sapiens
  misc_feature: GZ8MTXP01DTNT5.39.87.H10.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtagganacagagtcaccatcacttgccgggnaagtcagggacaattaaaaatgtatttagcctaggtatcagacaagaaaaccagggaaaactcctaaaggtcctagatctaatgaatcgccttacgtaaggttttagggaaacggttcgggggttaccccaagtaccgtaaacggtttccgaaggcgggtacgaaggttgggaaacgttcgtgggggtaaactaagggttaaacctttttacccgaacctttccttacctaaacccctaacttacccaaacccgaacgggtccccgttagggcccgggtaacccgtttagggtaaacgttattttttacggaaaccttaaaccgttttaatttaacccttagggtttaaacccttaaaactttaaaattttttaacgtttacctttaacgttcccgtacttaccggttacccgttttcggggacgggtaacgggtaaccggtaaagggttcggaaagtaacttaacgaaaacggttacgttagggttcgggttacctggacctaaccgtatccttcgtttccttcgttaacccg

SEQ ID NO: 350938 - DNA, 640 bp, Homo sapiens
  misc_feature: GZ8MTXP01DOEE6.39.87.H10.1.454.CMB.2.raw
  modified_base (588)..(588): a, c, t, g, unknown or other
  misc_feature (588)..(588): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccggactgaggtgaagagccgtgggcctcgagtgaaggtctctgcaggcttctaggatccacctcaccgtacgtctatatcgacacgttggttcgacgacgacggtcccccgtaggaaccgaaggggtcctttaggaggtggagttgggggatagggtatacgaaacggtaactaggttcggtactacaactaaagttagtcgaactaacgaagttaaacgtttcggaaggggcacgggggttaccaacccgtaagttaccggaacccgaaggggaaccctacgttacccaattaccaaacttacgaacgtaccttaacagttaggggaactaggagacgagggctaggacgtaactcgtagaccgacgacggtcgttagttatagttgcgagagngttagtggaacttaacttcgttacgttaagttaacggtttcggggttaaggg

SEQ ID NO: 350939 - DNA, 511 bp, Homo sapiens
  misc_feature: GZ8MTXP01AX5KF.39.87.H10.1.454.CMB.2.raw
  modified_base (292)..(292): a, c, t, g, unknown or other
  misc_feature (292)..(292): n is a, c, g, or t
  modified_base (343)..(343): a, c, t, g, unknown or other
  misc_feature (343)..(343): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
tcagtcgcactagtcacgaccggtgctcgatttagcagtactgcgttgggtttggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaatgattagctggtatcagcagaaaccaggaaactctaaaggtctgatctangatgcctcagtttggaaagtggggtccagtccaaggtcagcgcaagttggntctgggacagtatttcactctcaccatcacagcctgcgctgaaacttnttgactattatactntacaatattatctacgtctctctacgttcgggcggtaaggacgagggtcgagtaacgtaacgaaacgacgttggtaaggtctcgaccacttacgttcgttcgtcc

SEQ ID NO: 350940 - DNA, 585 bp, Homo sapiens
  misc_feature: GZ8MTXP01BQ5GN.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggtcttcgtggaatccaccctcaccgacgtctatatgcacgtggttgcgacacggccccctggacaagggcttggagtggatgggatggatcgaaaccggtacagtggtactacaaaacgtaaattgtgacaacgagtaaagtttcgaggggcagggtacacgatcgaccgagggacacgtcatacaaagtacagacctacgaagttcgggaaacctgacgccgagggtactaggacgtacgtacgtacggaaccgaaccgacgggttaccgttaggttaacttaagttggttcgcgagaacgtagtaagtacgtacgttcttaacgttaacgttaagggg

SEQ ID NO: 350941 - DNA, 532 bp, Homo sapiens
  misc_feature: GZ8MTXP01DI0ED.39.87.H10.1.454.CMB.2.raw
  modified_base (409)..(409): a, c, t, g, unknown or other
  misc_feature (409)..(409): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaaggggcttgagtggatgggatgtatcaaccccgagagtggacgaacacaaaataatgcacagagtattcgagggcagggtcacatgacgtcggacacgtcatacaaacncgacctacataggggtaattcaagtagactagagtaccaaacgacaccggccgtgtacttctgttggcgagacggacagttacggttccaacgtaggggaataaggtgacgtaagttcgtaag

SEQ ID NO: 350942 - DNA, 509 bp, Homo sapiens
  misc_feature: GZ8MTXP01CMVNT.39.87.H10.1.454.CMB.2.raw
  modified_base (246)..(246): a, c, t, g, unknown or other
  misc_feature (246)..(246): n is a, c, g, or t
  modified_base (455)..(455): a, c, t, g, unknown or other
  misc_feature (455)..(455): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
  modified_base (490)..(490): a, c, t, g, unknown or other
  misc_feature (490)..(490): n is a, c, g, or t
tcagtcgcactagtcacgaccggtgctcgatttagcagtactgcgttgggtttgggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttcnggaatcaccctcaccgacgtctatatgcactggtgcgacaggccccctggacaagggcttgagtggagtgggatggatcgaacggtacagtggtctcaactaaattaatgcactaagagtttcgagggcgagggtcacatgacgagggacacgtcatacaatacagcctacagtaggggaactgagacgaggctagagatctgacgacncggcgtagttattattgtcgngagngatgagtctnttcttatgttggttaaggg

SEQ ID NO: 350943 - DNA, 525 bp, Homo sapiens
  misc_feature: GZ8MTXP01A05UI.39.87.H10.1.454.CMB.2.raw
  modified_base (361)..(361): a, c, t, g, unknown or other
  misc_feature (361)..(361): n is a, c, g, or t
  modified_base (489)..(489): a, c, t, g, unknown or other
  misc_feature (489)..(489): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggttgcgacacggcccctggacaagggcttggagtggagtgggatggatcgaacggtacagtggtctacgaaacaaattngacaacagtaagtttcgagggtcgagggtcaccagtagaccgagggacacgtcatcaatacagcctagagtggaactgagcgagctagagtagtctacgacgaacacggccgtgttagttagtgttgngagaagatgtagtcttcttaaccgttaagttaaggg

SEQ ID NO: 350944 - DNA, 591 bp, Homo sapiens
  misc_feature: GZ8MTXP01EGTWH.39.87.H10.1.454.CMB.2.raw
  modified_base (461)..(461): a, c, t, g, unknown or other
  misc_feature (461)..(461): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaaggaagccgtggggcctcgagtgaaggtctcctgcaaggtcttcgtaggaatccaccctcaccgacgtctatatgctacgtggtcgacgacgacggccccgtggacgagggtcttggaggtggagttgggatggatacgaacggtactagtcggtactacaactaaattactacgcacgtaaggtaagtttcgagggtacgacgggtacaccgagtacgacgacggactacgtacatacaatacacgcctaanacgtacgggaaactggaacgcgagcgtaggacgtaagtcgtagacgaccgcggtcttagttattagttgacggngagnggttatgggtacttaacttccgtacttagttaaggttcggggttttaaaggg

SEQ ID NO: 350945 - DNA, 536 bp, Homo sapiens
  misc_feature: GZ8MTXP01A30AU.39.87.H10.1.454.CMB.2.raw
  modified_base (251)..(251): a, c, t, g, unknown or other
  misc_feature (251)..(251): n is a, c, g, or t
  modified_base (366)..(366): a, c, t, g, unknown or other
  misc_feature (366)..(366): n is a, c, g, or t
  modified_base (485)..(485): a, c, t, g, unknown or other
  misc_feature (485)..(485): n is a, c, g, or t
  modified_base (497)..(497): a, c, t, g, unknown or other
  misc_feature (497)..(497): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactccccaggtgcagctggtgcaggtccgggactgaggtgaagaagccgtggggcctcgagtgaagtctctgcagctcnggatcaccctcaccgacgtctatatgctacgtggttgcgacgacggccccgtggacgaaggtcttggagtggagtgggatggatacgaaccggtacagtgtcacgaaacaattgnacaacgagtagttcgaggtcgaggtacacgatcgacgaggacacgtacactacaactacgacgacctacgagtaggactgacgtcgagcgtgacgtagtcacgacgaacgacgttcgtnttacgttagtgngcgagtaagagtgtagtacttcttaacgttgttaacggg

SEQ ID NO: 350946 - DNA, 509 bp, Homo sapiens
  misc_feature: GZ8MTXP01DMOYF.39.87.H10.1.454.CMB.2.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (449)..(449): a, c, t, g, unknown or other
  misc_feature (449)..(449): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
tcagtcgcactagtcacgaccggtgctcgatttagcagtactgcgttgggtttgggggagcatcacccagcaaccacatctgtcctctagagaatcccctgagagctcagttcctcaccatggactggacctggaggatcctcttcttggtggcagcagccacaggagcccactcccaggtgcagctggtgcagtccgggactgaggtgaagagcctggggcctnagtgaaggtctcctgcaggcttcnggaatcaccctcaccgacgtctatatgcactggttgcgacaggcccctggacaggcttgagtggatgggatggatccgaaacggtacagtggtctcaactaattatgacacagaagtttcgagggcaggtcacatgaccgagggacacgtcatacaatacagcctacagtaggaacgtgacgcgaggtctagagatccgngaacgacgacggtccgttagtattagttgttgnggaagagntcgagttactcttcgtaag

SEQ ID NO: 350947 - DNA, 615 bp, Homo sapiens
  misc_feature: GZ8MTXP01D4TXJ.39.87.H10.1.454.CMB.2.raw
  modified_base (567)..(567): a, c, t, g, unknown or other
  misc_feature (567)..(567): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggctctggatccaccctcaccgacgtctatatgaccacgtggttgccgacgacggcccccgtaggaacgaagggctttaggagtggagtggggatggactacgaaacggtaactaggtcggtactacgaaactaaatttaactacggaaccaaacgtaaagggttaaacggtttcgaagggggtccgtaaggggttacccaaccgtagtacggaaccgaaggggaccacggtaccattaacaactacagaccctaagacgtagggggaactggaagaccgaggcgtagagtactcgtagacgacgcggtccgtagttattagttgngtacgaggagagtgtagtaactcttacgttagttgttgggtttaaggg

SEQ ID NO: 350948 - DNA, 697 bp, Homo sapiens
  misc_feature: GZ8MTXP01D1SM1.39.87.H10.1.454.CMB.2.raw
  modified_base (247)..(247): a, c, t, g, unknown or other
  misc_feature (247)..(247): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtgggcctcagtgagtctctgcaggctgnggaactcaccctcaccgacgtctatatgctacgtggttcgcgacgacggcccctaggacgaagggcttaggagtggagtgggatggatacgtaaaccggtactaggtcggtactacgaaaactaaattgtagacctaaacgtaaaggtaacggtttcggaagggggtaccgaacgggggttaccaaccgtaagtaccggaaccgaacggggtaaccaccggttaccaataaccaaacttaaccgaacgtaccccgttaaaggaacggttaacgggtaaaccttaggggaacggaccgggtacggtaccgtaaaggaaccggtagttaccggtaacggaaccgaaccgtacgggttaccggttaggttaacttaagttcgggttagttcgggttaacgaagggtaaacttcggtaaaggttcgttacctttaacgttaacgggtttaaggg

SEQ ID NO: 350949 - DNA, 573 bp, Homo sapiens
  misc_feature: GZ8MTXP01DIJ73.39.87.H10.1.454.CMB.2.raw
  modified_base (389)..(389): a, c, t, g, unknown or other
  misc_feature (389)..(389): n is a, c, g, or t
  modified_base (423)..(423): a, c, t, g, unknown or other
  misc_feature (423)..(423): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttcgtggaactccaccctcaccgacgtctatatgctacgtggttcgccgacgacggcccccgtagggaaccgaagggtcttaggaggttggagtggggataggatacgaaaccggtacaggtcgtactacaaactaaattnagacaacgagtaagttcgagggacagggtcaacngagacaggacacgtcaatacaatacacgcctacgagtaggaactggacgcgagcgtagagtactcgtagacgaacgacgggttcgttaggttattagtgttaggcgaaggtaagtataaggtacttacgttacttcgttaacgttaaggg

SEQ ID NO: 350950 - DNA, 788 bp, Homo sapiens
  misc_feature: GZ8MTXP01BJ54D.39.87.H10.1.454.CMB.2.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
  modified_base (460)..(460): a, c, t, g, unknown or other
  misc_feature (460)..(460): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttggccggganaagtcagggactaaattaaaagtgtatttagctggtancagacaagaaaccaagggaaactccgtaaggtcctagatctatgatcgccttacgtaggtttagggaaacggttcggggtaccctagtacgtaaagggtttcccagggtcgggacgtaaggtcggtaaacgttccggtaagggggtacctagggttaacttttccaaccttcctaccaaccctactaccaaacccgnggtcccgttaggacccgggtacccgttagggtaaactttacttttacggacctttaaaacgttttactttaaccgttaacgggtttaaacttaaaacttttaaactttttaaaccgttttaccctttaaaccgttccccgttacgttttaaccccgggttaaaccgggttttacccgggggaacggggtaaaccggggttaaacccggaaagggggtttacggggaaattaaaccggttaaaccgtaaaaaccggtaacgttcgggttccgggttacttaacggacctaaccctggtttacccttcgttcccgttttaactaaccccg

SEQ ID NO: 350951 - DNA, 566 bp, Homo sapiens
  misc_feature: GZ8MTXP01C64P8.39.87.H10.1.454.CMB.2.raw
  modified_base (376)..(376): a, c, t, g, unknown or other
  misc_feature (376)..(376): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagaagccgtggggcctgagtgaaggtctcctgcaaggcttcgtggaatccaccctcaccgacgtctatatgcacgtggttgcgacgacggccccgaggacgaagggcttggagttggagtgggatgggatacgaaaccggtacaggtggtctacgaaaactaaattngacaacaagtaacgttcgagggacagggtcaccgatgaccgagggacacgtcaatacaagtacagacctagaagttagggaactggagacgaggacgtagaagtacgtacgaggaacgaacgacgggttccgttagttagttaagttgacggcgagaagtatgtacgtattcttaacgttaagttaaggg

SEQ ID NO: 350952 - DNA, 567 bp, Homo sapiens
  misc_feature: GZ8MTXP01B6MKD.39.87.H10.1.454.CMB.2.raw
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttcnggaatccaccctnacccgacgtctatatgcactggttgcgacacggcccctaggaccaaggggtcttgaggtggagtgggatggatcgaaacggtaacaggttggtctacaacaaattatagcacaaggtaagtttcgaggggacagggtacaccatagacgaggacacgtaccatacaatacacgacctaacagtacggggaactaggacgacgacggacgtttagagtacgtctaggacgacgacggtaaccggtagttagttagttagtcggtgagagatggacttaactacttcttacttaagttgggtttaaggg

SEQ ID NO: 350953 - DNA, 644 bp, Homo sapiens
  misc_feature: GZ8MTXP01A1ZT7.39.87.H10.1.454.CMB.2.raw
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
tcagtcgcactagtcacgaccggtgctcgatttagcagtactgcgttgggtttgggggagtcagacccactcaggacacagcatggacatgagggtccccgctcagctccgtggggcttctgctgctctggctcccaggtgccagatgtgccatccagttgacccagtctccatcctccctgtctgcatctgtaggagacagagtcaccatcacttgccggnaagtcagggactaattaaaatgattagctgtancagcagaaaccaggaaactcgtaagtcctagatctatgatcgccttacgagtttaggaaacgtggggtacccatacgaaggttccgaggcggacaggtggaatcgtgggaactagtactttcactctacaccatccaccgacgccgtacggccggtacctaggtaacgttacgttttacgaccttaaactttatttaaccgtacggggttaactaaacctttaaattttaacttacctttaactcccgttacttaccgtaccgtttccggggaccgggtaaacgggacccgtaaaggggtcggaacgtaacgttaacgaaaccggtaacgttcggttacgggttctaacggacctaacctagttccgttagttcctttaacgtaacccg

SEQ ID NO: 350954 - DNA, 635 bp, Homo sapiens
  misc_feature: GZ8MTXP01D93NO.39.87.H10.1.454.CMB.2.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttcgacccagtctccatccctccctgtctgcatctgtagganacagatcaccatcactgccggganaagtcagggacaattaaaatgtattagcctaggtatcagacaagaaaaccaagggaaaacctcgtaaaggtcctagtatactatgatcgcccttacgtaggtttaggaaaggtcgggtacctagtacccgtaaggttcgaaggccggacgtaaggtacggtaagtcgtaggggactaggtactttcactccctacaacctaacgtccaacgtcgccgtacggccggtaacctaggtaaagttactttcgaaactttaactttattacgtattaaaccctaaatttaatttaacttcttaactcccgtctcgtaaccgttcgggaccgggtaaacggtaacgttaagggtagaacgtaactaaccgaaagttacgttgtaacggctctaccaacttgttcttcgtaacc

SEQ ID NO: 350955 - DNA, 755 bp, Homo sapiens
  misc_feature: GZ8MTXP01EM0TY.39.87.H10.1.454.CMB.2.raw
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgaagtctctgcaaggcttcnggaactcaccctcaccgacgtctatatgcactggtgcgacncggcccctggacaaggcttgagtggagtgggatggatacgaaacggtaaccaggttaggtctacgtaactaaaaaatttagtcggactaaacgtaacggtaaaggttttaccggaacgggggtacgtaacgggggttaccaaacccgtaagttacggggaaacccgtaacgggggaaacccgtaaccgggttacccctaaagttaacccaaaacttaaaccgaacggtaaccccttaaaccgtaaaggttaacggggtaaaaccgttagggaaacggaccgaacgggaccgttacggaaagtaacgttccgtacggtaacccggaaacggaacccggggttacccggtttacgggttaaactttaaacggttgggttaccgggacgggttaagggaacggtaagttaggtaaccggtttaaaccgttccgtttacccgttaaggtttaaccgggttttaacgggggg

SEQ ID NO: 350956 - DNA, 554 bp, Homo sapiens
  misc_feature: GZ8MTXP01C4LJJ.39.87.H10.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
  modified_base (444)..(444): a, c, t, g, unknown or other
  misc_feature (444)..(444): n is a, c, g, or t
  modified_base (536)..(536): a, c, t, g, unknown or other
  misc_feature (536)..(536): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctcctgtctgcatctgtagganacagagtcaccatcacttgccggnaagtcagggacaattaaaatgatttagctggtancagacaagaaaccagggaaaactctaaggtcctagatctatgatgacctcgtagtttggaaggttcgggtccagtcaaggttccaggcggcagtggaatcgtgggacagtattcactctcacntacacagctgcgactagaagtntttgactacttatactgtactaataatttactacgttatccctnttaccgtacgttcgggacggtaacgggaacgtaagggtggaaagtacgttaacgtaaacgtacgttggttcggaccgtaagacctaaccgtntcttcgttccttcgtaac

SEQ ID NO: 350957 - DNA, 611 bp, Homo sapiens
  misc_feature: GZ8MTXP01CM4OT.39.87.H10.1.454.CMB.2.raw
  modified_base (254)..(254): a, c, t, g, unknown or other
  misc_feature (254)..(254): n is a, c, g, or t
  modified_base (372)..(372): a, c, t, g, unknown or other
  misc_feature (372)..(372): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcgagtgaaggtctcctgcaaggcttcnggaatccaccctcaccgacgtctatatgcacgtggttgcgacacggcccctggacaagggtcttggagtggagtgggatggatcgaaaccggtacaggtggtactacaaactaaattntgaccaacgtaaggtaacgtttcgaaggggcgtacggggtaccaacccgtagtacggaacccgaaggggaaccctaaccggtaccaattaccgaaattaccgaacgaccccttaagaacgttacgggaaacctggaacgcgagggctaggagtatcgtacgacgaacgacgggttcgtagttacgttagtggttagcgagaagtatcggtagttacttcttaacgttaacgtttaaggg

SEQ ID NO: 350958 - DNA, 629 bp, Homo sapiens
  misc_feature: GZ8MTXP01DUY8O.39.87.H10.1.454.CMB.2.raw
  modified_base (246)..(246): a, c, t, g, unknown or other
  misc_feature (246)..(246): n is a, c, g, or t
  modified_base (607)..(607): a, c, t, g, unknown or other
  misc_feature (607)..(607): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatccctccctgtctgcatctgtaggagacagatcaccatcacttgccgggcaagtcagggacaattaaaangtattagcctggatcagacagaaaccaggaaactctaaaggtcctgatctatgatgcccttcgtagtttaggaaacgttcggggtaccctaagtcccgaaagggttcgaaggccgggtacgtaaacgggtggtaagttccggtaggggaacctaggttaactttcgacttcctacaccataccacctacgtccgtcggacggtacctaggaacgttatttacgactaaacctttattaccgttataactaaacttaaattttaaacttctttaactccgtcttcgtaccgtttcggggacgggaagggtacccaaggggtcggaaagtacgttaacgaaaacgttacgttggtaagtcgtnccgtaaccttcttcgttcgttc

SEQ ID NO: 350959 - DNA, 575 bp, Homo sapiens
  misc_feature: GZ8MTXP01D869N.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggacgcccactcccaggtgcagctggtgcagtccgggactgaggtgaagaagccgtgggcctcgagtgaaggtctcctgcaaggcttctggaatccaccctcaccgacgtctatatgctacgtggttgcgacacggccccgtaggacgaagggtcttagacggtggagtgggagtggatacgaaacggtaactaggttcggtactacgaactaaatttagcgaacactaaggtaacgtttcgaggggtcagggtcaaccgagtacggacgagggaacacgtaccatacaatacagctaacatagggaactgacgcgagcgtgacgtatcgtgacacgcggtcttgttaaattgttggtggacgagttgttacgtgtacgttcttacgtacttacggttaaggttcgggggttaag

SEQ ID NO: 350960 - DNA, 590 bp, Homo sapiens
  misc_feature: GZ8MTXP01BML5Y.39.87.H10.1.454.CMB.2.raw
  modified_base (220)..(220): a, c, t, g, unknown or other
  misc_feature (220)..(220): n is a, c, g, or t
  modified_base (539)..(539): a, c, t, g, unknown or other
  misc_feature (539)..(539): n is a, c, g, or t
tcagtcgcactagtcacgaccggtgctcgatttagcagtactgcgttgggtttgggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtgggcctnagtgaaggtctctgcaggcttctggaatccaccctcaccgacgtctatatgctacgtggtcgaccgacgacggcccccgtaggaacgtaaggggtcttaggaggtgggagtggggatggatacgaaacggtacaggttggtactacaactaaattatagcaacgtaggtaaacgtttcgagggtacgagggtaccacgatacgacgagggaccacgtacatacaactacacgacctaacagtacgggaactggagcgaggctagagtactcgtcgaccgtacgacgggtcgttagttagttagttggtagaggttaagngttagtgtaacgttaacttcgttacttaggttggttaaggggtttaacggg

SEQ ID NO: 350961 - DNA, 571 bp, Homo sapiens
  misc_feature: GZ8MTXP01DRTHW.39.87.H10.1.454.CMB.2.raw
  modified_base (476)..(476): a, c, t, g, unknown or other
  misc_feature (476)..(476): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagtcgcactagtcacgaccggtgctcgatttagcagtactgcgttgggtttggggatcacccagcaaccacatctgtcctcgagagaatcccctgagagctccgttcctcaccatggactggacctggaggatcctcttcttggtggcagcagccacaggagcccactcccaggtgcagctggtgcaggtccgggactgaggtgaagaagccgtggggcctcagtgaaggtctctgcaaggcttcgtagaactccaccctcacccgacgtctatactgacacgtggttcgacgaccgacggcccctggacgaagggtcttgagtggatgggatggatacgaacggtacaggtcggtactacaactaattaatgctacaaggtaaacgttcgagggtcgagggtaccaccgagtacgaacgacggaccacgtaccaatacaactacgacgacctaagacgtaggggaactggacncgagcgtagagtactgagacgacgtaccggcgttgttattgttcggacgngagttnaggtgtagttcttctacgttagtggttcgggtttaaggg

SEQ ID NO: 350962 - DNA, 582 bp, Homo sapiens
  misc_feature: GZ8MTXP01BP081.39.87.H10.1.454.CMB.2.raw
  modified_base (343)..(343): a, c, t, g, unknown or other
  misc_feature (343)..(343): n is a, c, g, or t
  modified_base (461)..(461): a, c, t, g, unknown or other
  misc_feature (461)..(461): n is a, c, g, or t
  modified_base (539)..(539): a, c, t, g, unknown or other
  misc_feature (539)..(539): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcgaggtccgggactgaggtgaagaacgccgtgggcctcgagtgagtctctgcagctctgactcaccctcaccgagtctatatgcacgtggtgccgacgcggcccctaggacgaagggtcttggagtggagtgggatggatcgaacgtaacnggtcggtactcgaaaactaaattgtagacaacgagtaacggtttcgagggcgagggtcacgagtacgacgagggactacgtcatacaaacgtacacgacctagagtacgaactgggancgaggtctaggacgtagtacgacggacgaaccgtcgggttcgtacgttagttaagttggcgttcggaaggaaccgggntaacggtacgtttacccgaagggttaagggttaaagttaaggg

SEQ ID NO: 350963 - DNA, 552 bp, Homo sapiens
  misc_feature: GZ8MTXP01DFS97.39.87.H10.1.454.CMB.2.raw
  modified_base (242)..(242): a, c, t, g, unknown or other
  misc_feature (242)..(242): n is a, c, g, or t
  modified_base (278)..(278): a, c, t, g, unknown or other
  misc_feature (278)..(278): n is a, c, g, or t
  modified_base (356)..(356): a, c, t, g, unknown or other
  misc_feature (356)..(356): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagctgggcctcagtgagtctctgcaaggcttcnggaactcaccctcaccgacgtctatatgcactggtncgacacggcccctggacagggcttggagtggatgggatggatacgaacggtacaggtgtactacgaactaaaattagngaccaagtaagtaacgtttcgaggggtacagggtacaccgagcgaacgagggacacgtccatacaaanacaacgcctaaanaggtacggaactgacgacgagctagacgtctacgacgaccgacgtaacggtcgttagttagttagtgtcgaggagagtaatagtaacttactcttacgtaacgttaagggttggg

SEQ ID NO: 350964 - DNA, 538 bp, Homo sapiens
  misc_feature: GZ8MTXP01A7VV0.39.87.H10.1.454.CMB.2.raw
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
  modified_base (420)..(420): a, c, t, g, unknown or other
  misc_feature (420)..(420): n is a, c, g, or t
  modified_base (500)..(500): a, c, t, g, unknown or other
  misc_feature (500)..(500): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagagccgtggggcctcagtgaaggtctcctgcaaggcttctggaatcaccctcaccgacgtctatatgcactggttgcgacacggcccctggaccgaagggtcttggagtggagtgggatggatcgaacggtanagtgtctcaaacaattngacacagtaagttcgagggcagggtcacgatcgacgaggacacgtacatacaatacanacctagagtaggaactgacgcgaggcgtagagtaacgtcgtagaccggaacgacgggttccgtaggttattagtgttagngagaagagtaagtagtacttcttcgttaacgttaaggg

SEQ ID NO: 350965 - DNA, 528 bp, Homo sapiens
  misc_feature: GZ8MTXP01CJNF5.39.87.H10.1.454.CMB.2.raw
  modified_base (223)..(223): a, c, t, g, unknown or other
  misc_feature (223)..(223): n is a, c, g, or t
  modified_base (246)..(246): a, c, t, g, unknown or other
  misc_feature (246)..(246): n is a, c, g, or t
  modified_base (447)..(447): a, c, t, g, unknown or other
  misc_feature (447)..(447): n is a, c, g, or t
  modified_base (494)..(494): a, c, t, g, unknown or other
  misc_feature (494)..(494): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagagccgtggggcctnagtgaaggtctctgcaggcttcnggaatcacctcaccgacgtctatatgctactggttgcgacacggcccctggacaagggcttgagtggagtgggatggatcgaacggtaaccagtggtactacgaactaaaattatgacaacgagtaagtttcgaggggtcagggtacaccgagtagaccgagggacacgtcaatacaatacagactacagtgaactgacgnaggctagagatcctagacgacgaacggtcgttgtattagtgtgacgngagtaatggtaatactcgttactcgttgttcggg

SEQ ID NO: 350966 - DNA, 551 bp, Homo sapiens
  misc_feature: GZ8MTXP01C8KFR.39.87.H10.1.454.CMB.2.raw
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (411)..(411): a, c, t, g, unknown or other
  misc_feature (411)..(411): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtagganacagatcaccatcacttgcggnaagtcaggnaattaaaatgattagctggtancagacaagaaaccagggaaaactccgtaaggtcctgatctatgatcgcctccgaggttttaggaaaggtggggtaccccatcgtaagggttccaggcggcaggtggaatcgtgggacagtactttcactctacacctatcaccagcctgcgactagtaagtntttgactaattattactagtactaattaatttattcttactcgtctctacgttcgggcggtacggacctaagggtcgaagacttacgaaaacggtcgttaggttcggactcgactaacctatccgttattccttaactcc

SEQ ID NO: 350967 - DNA, 650 bp, Homo sapiens
  misc_feature: GZ8MTXP01CYV1J.39.87.H10.1.454.CMB.2.raw
  modified_base (246)..(246): a, c, t, g, unknown or other
  misc_feature (246)..(246): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagaagccgtggggcctcgagtgaaggtctccgngcaaggcttcgtggaactccaccctcaccgacgtctatatgcacgttggtcgcgacgaccggccccgtaggacgaagggtcttggaggtggagtgggataggatacgaaaccggtaacgtaggtggtactacaaaactaaattgacgacaaacgtaggtaaagtttcgaaggggcgaaggggtaccaacgtagtacgaaccggagggaacctaccggtaccaacgtaacaaataccgaacgtacctaacggagtaacggtaaactgggaacgccgaaggtacgtaacggaagtacgtaccgtacggaacgaaccgtaacgggttcgtagttagttaagttcggttagcggttaaagaagtagttaacgaacgttacgttacgtttaacgttaaggtttaacggg

SEQ ID NO: 350968 - DNA, 570 bp, Homo sapiens
  misc_feature: GZ8MTXP01CPI2Q.39.87.H10.1.454.CMB.2.raw
  modified_base (369)..(369): a, c, t, g, unknown or other
  misc_feature (369)..(369): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagccccactcccaggtgcagctggtgcagtccggactgaggtgaagagcctggggcctcgagtgaaggtctcctgcaaggcttcgtggaactcaccctcaccgacgtctatatgcactggttgcgacacggcccctggacgaaggcttgagtggagtgggatggatcgaaacggtaaccaggtggtactacaactaaaaatttangacaacgagtaagtttcgaggggtcaggggtccacgatcgaccgagggacacgtaccaatacaatacagacctaacagtaggaactgacgcgaggctaggacgattccgaggaaccgacgaacgggtcgttaggttattagttggtgacggaggagtaatggtaagtacgttcttacgttaacgttaaggtttaacggggg

SEQ ID NO: 350969 - DNA, 740 bp, Homo sapiens
  misc_feature: GZ8MTXP01AOL8Z.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggagtgggatggatcgaaacggtaacagtggtactacgaactaaagttaatggcaactaagggtaaacgtttcgaggggtacaagggggttaccaacccgtatacggaacccgaagggggaacctaccgggttaccccaagttaccaaattaaccgaacggtaccccttaaacgaagttacggggggaaaccttgggaaacgacccgaaggggacccttagggaaacgtacgttccgttacgggtaaacccggtaaccggaaccggggtaaccccggttaagggttttaaacgttttaaacggtttcgggttagggaacccgggttaagggttaaacggttaacgtttaagggtaacgggttttaaaccctttcccgtttacgtttaaacccgtttaagggttttaacgggggtttttaaaccgggggg

SEQ ID NO: 350970 - DNA, 553 bp, Homo sapiens
  misc_feature: GZ8MTXP01AT6WI.39.87.H10.1.454.CMB.2.raw
  modified_base (284)..(284): a, c, t, g, unknown or other
  misc_feature (284)..(284): n is a, c, g, or t
  modified_base (439)..(439): a, c, t, g, unknown or other
  misc_feature (439)..(439): n is a, c, g, or t
  modified_base (511)..(511): a, c, t, g, unknown or other
  misc_feature (511)..(511): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgaaggtctcctgcaaggcttctggaatcaccctcaccgacgtctatatgcactggtncgacaggcccctggacaggctgagtggatgggatggatcgaacggtaaccagtggtctacaactaaaattatgacaacgagtaagtttccgaggggtcaggggtccaaccgtagtcgaccgaggggacaacggtccatacaacttacagacctanagtacggaactgacgcaggtctagacgagtctagacgcaacggtcgttgttattagtggtagcgttagagtntaggtaactaccttgttacccttaagttaagtttaacggggg

SEQ ID NO: 350971 - DNA, 574 bp, Homo sapiens
  misc_feature: GZ8MTXP01B5D2B.39.87.H10.1.454.CMB.2.raw
  modified_base (453)..(453): a, c, t, g, unknown or other
  misc_feature (453)..(453): n is a, c, g, or t
  modified_base (526)..(526): a, c, t, g, unknown or other
  misc_feature (526)..(526): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttctaggaactccaccctcacccgacgtctatatcgcacgtggttcgacgacacggcccctaggacgaagggtcttagaggtggagtgggatggatacgaaacggtacaggtggtactacaactaaattaatgcaacgaagtaacgtttcgagggtcgagggtacaccgagtcgaacgaggacacgtacagtacaagtacagacctanagtacggggaactgacgacgaggctagagtacgtcgtagacgacgcggtccgtagttattagttgtagcgagngttagtgtagttaacttcgttacgttacgttggttcgggtttaacggg

SEQ ID NO: 350972 - DNA, 614 bp, Homo sapiens
  misc_feature: GZ8MTXP01BN284.39.87.H10.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (260)..(260): a, c, t, g, unknown or other
  misc_feature (260)..(260): n is a, c, g, or t
  modified_base (434)..(434): a, c, t, g, unknown or other
  misc_feature (434)..(434): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctggtagganacagagtcaccatcacttggccggnaagtcagggactaattaaaatgtatttagcctggtancagacaagaaaccgaagggaaaactccgtaaggtcctagatctatgatcgcctacgtagtttagggaaagtcgggtaccagtcgtaaggttcaggcggactaggtggaactcgtgggactagtactttcactctacactacgtcaaccgtgcctgacgggtacctaggtaattntttacgactaaactttacttacttacggtaactaaactttaaatttacttacctttactccgtcttacgtcgtttaccgggggcgtaacggggaacctaaaggggtcggaagtaacttaacggaaaacgtacgttggttaggttacctgaacctcgttactcgttcgttaacttccgtcg

SEQ ID NO: 350973 - DNA, 556 bp, Homo sapiens
  misc_feature: GZ8MTXP01D3TGQ.39.87.H10.1.454.CMB.2.raw
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactgaggtgaagagccgtggggcctgagtgaaggtctcctgcaaggcttcgtggaactccaccctcaccgacgtctatatgcacgtggttgcgacacggcccctggacgaagggtcttggagtggagtgggatggatacgaaccggtacaggtgtactacaaaactaaattgtgacaacgagtaacgttcgaggggtacagggtcaacagtacgaccgaagggacacgtacatacaatacagacctaacgagtaggaactggagcgaggntagagtntcgagacgaacgcggttcgtgttagtagtgttagcgagaagtagtggtactacgttacttaacgttaagtttaaggg

SEQ ID NO: 350974 - DNA, 614 bp, Homo sapiens
  misc_feature: GZ8MTXP01AITFH.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagcctggggcctcagtgaaggtctcctgcgaaggtcttctgggaactccaccctcaccgacgtctatatgcacgtggttgcgacgacggcccccgtaggacgaagggtcttaggagtggagtgggatggatacgaaacggtacgagtggtcacgaaactaaattgtacgacaacgtagtaacgtttcggagggcgtagggtccaacgtagtacgaaccggtacgggacctaccgtacctaacgtacaaagtaaccacgtacccgtaactacgtacggaacctaggacgcgaggctaggatgtacgtacgaccgaacgtacgggttccgttgttaagtttagttgttcgggcgttaaggaagtacgtgtacgttacgttacctttaacgttaacgtttaagggg

SEQ ID NO: 350975 - DNA, 556 bp, Homo sapiens
  misc_feature: GZ8MTXP01ATY8Q.39.87.H10.1.454.CMB.2.raw
  modified_base (198)..(198): a, c, t, g, unknown or other
  misc_feature (198)..(198): n is a, c, g, or t
  modified_base (260)..(260): a, c, t, g, unknown or other
  misc_feature (260)..(260): n is a, c, g, or t
  modified_base (463)..(463): a, c, t, g, unknown or other
  misc_feature (463)..(463): n is a, c, g, or t
  modified_base (535)..(535): a, c, t, g, unknown or other
  misc_feature (535)..(535): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtagganacagagtcaccatcacttggccgggcaagtcagggactaattaaaaatgtattagcctgtancagacaagaaaccaaggaaactctaaggtctgatctatgatgacctcgtagtttacggaagtcgggtaccagtacgtaaggttccaggtgacgagtcgaatcgtgggactagtattcgactctacacctactaccaccagtccgtggacgtactagtactatttgactaacgttatactagtactaagttatttactcttacncgtctacgtcgttccggaggacggacgtaagggtcggatagttaacgaaacgtagttgttacggctcgaccnctatcgttcttccttctaacg

SEQ ID NO: 350976 - DNA, 535 bp, Homo sapiens
  misc_feature: GZ8MTXP01A9835.39.87.H10.1.454.CMB.2.raw
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (443)..(443): a, c, t, g, unknown or other
  misc_feature (443)..(443): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccggcaagtcaggcattaaaangattagctggtancagcagaaaccagggaaactcctaaggtcctagatctatgatgcctcagtttggaaagtgggtacccatcgaaggttccaggcggcagtggaatcgtgggacaggtattcactctacaccatcaccagcctgcggacctagaatactttgactaacttattactgtactaaatatttaactcttactccgntctacgtttcgggacggtacgggaccaagggtggaagtacttacgaaaacgtacgttgttcggactgccaaccattcttgtccttcgtaacc

SEQ ID NO: 350977 - DNA, 628 bp, Homo sapiens
  misc_feature: GZ8MTXP01AQ80H.39.87.H10.1.454.CMB.2.raw
  modified_base (559)..(559): a, c, t, g, unknown or other
  misc_feature (559)..(559): n is a, c, g, or t
  modified_base (581)..(581): a, c, t, g, unknown or other
  misc_feature (581)..(581): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcgagtgaaggtctctgacaaggtcttcgaggaatccacccctcacccgacgtctatatgcacgttggtcgcgaccgcggcccccgtggaacgaagggcttaggaggtggagtggggagtggatacgaacggtaactaggtcggtctacaactaaagttaactcggaactaactaaggtaaaggtttccggaaggggtaccgtaggggtacccaaccgtagtaccggaacgaacgggaccaccgtaccaattacaaacgtaccacgaccctaagtacgtacggggtaacgtgggaagccggaggcgtaggacgacgtcgtaacggaccgacgccgggtntagttagttgttgcggaagagnggttaatggtacttaagtcgtacttacgtaaggttggggtttaaggg

SEQ ID NO: 350978 - DNA, 643 bp, Homo sapiens
  misc_feature: GZ8MTXP01CLZ7C.39.87.H10.1.454.CMB.2.raw
  modified_base (611)..(611): a, c, t, g, unknown or other
  misc_feature (611)..(611): n is a, c, g, or t
  modified_base (624)..(624): a, c, t, g, unknown or other
  misc_feature (624)..(624): n is a, c, g, or t
tcagtcgcactagtcacgaccggtgctcgatttagcagtactgcgttgggtttgggggaaggagtcagacccactcaggacacagcatggacatgacgggtccccgctcagctcctggggcttctgctgctctggcctcccaggtgccagatgtgccatccagttcgacccagtcctccactcctccctgtctgcatctaggtaggagacagagtccaccatcacgttcggccgggacaaggtcgaagggactaaattaaaatgtaattacgctggatacagacaacgaaaccgaaggaaacctcgtaaggtcctagtactctatgatcgtacctacgtaggttacgggaaggttcgggtacctagtacgtaacggttcgacggcggacgtaggtcggacgttcggtacgggtaactagttactttaccgacttactacccaacctctaccaccgtacgtcccgtcggtaccgtactaggtaacttacgtttacaacctttaatttactttactaacgttaaccttaaacttaatttaacttccttactccgtacttcgtacggttcggacgggtacgaacgtaaggttggaacacgtaacgaagttacgngttcgctgtaacnctattctcgtttcgtaacc

SEQ ID NO: 350979 - DNA, 566 bp, Homo sapiens
  misc_feature: GZ8MTXP01C1DBT.39.87.H10.1.454.CMB.2.raw
  modified_base (258)..(258): a, c, t, g, unknown or other
  misc_feature (258)..(258): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
  modified_base (526)..(526): a, c, t, g, unknown or other
  misc_feature (526)..(526): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactgaggtgaagaagccgtggggcctcgagtgaaggtctccgtgcaaggtcttcgnggaactccacccctcaccgacgtctatatgcacgtggttcgcgacgacggcccctggacgaagggcttggagtggagtgggatggatacgaacggtanagtgtactacaaactaaatntgacaacgtaagtagttcgagggcagggtcaaccgagtacgaccgagggacacgtacagtacaatacacgtaccctaggacgtaggaactgacgacgaggtctagagtactcgagacgaacgtcggttccgtattagtttagtggttcgngaggaatagtggtaacttcttctttaacgaagtttaaggg

SEQ ID NO: 350980 - DNA, 566 bp, Homo sapiens
  misc_feature: GZ8MTXP01BWATY.39.87.H10.1.454.CMB.2.raw
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (296)..(296): a, c, t, g, unknown or other
  misc_feature (296)..(296): n is a, c, g, or t
  modified_base (371)..(371): a, c, t, g, unknown or other
  misc_feature (371)..(371): n is a, c, g, or t
  modified_base (523)..(523): a, c, t, g, unknown or other
  misc_feature (523)..(523): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactggaggtgaagaagccgtggggcctcgagtgaaggtctccgtgcaaggcttcgnggaactccaccctcaccgacgtctatangcacgtggtgcgacncggcccctggacgaagggtcttggagtgggagtgggatggatacgaacggtacaggtggtctacaactaaaattntcgcagtagtaagttacgaggggacagggtacacagtacgaccgagggactaccgtactatacaaatacacgtacctaacgacggtaggaacctggacgcgaaggctagagactcgtagacgacgcggtcgttagtacttagtcggtgacgngagtaatgtaacgttctcttagtaacgttaaggtttaacgggg

SEQ ID NO: 350981 - DNA, 577 bp, Homo sapiens
  misc_feature: GZ8MTXP01EAANR.39.87.H10.1.454.CMB.2.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (357)..(357): a, c, t, g, unknown or other
  misc_feature (357)..(357): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccggatgaggtgaagagcgtgggcctnagtgagtctctgnagctngatcacctcaccgatctatatgctacgtggttgccgacgacggcccctaggacgaagggtcttggagtggagtggatggatacgaaacggtacaggtgtctacaaacaaattgtnacagagtaagttcgagggcaggtcactagtagaccgtagggacacgcactacaaactacaagaccctaacgagtacggtaaaccgtggaacgcgtaggcgtaggagtacgttacgtacggaacgaaccgtcgggttccggttaagttagttacgttgggttaggcggaaggtaagtagttcggtacgttaccgttctttaaccgttaacgttttaagggg

SEQ ID NO: 350982 - DNA, 535 bp, Homo sapiens
  misc_feature: GZ8MTXP01BRRZ8.39.87.H10.1.454.CMB.2.raw
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (517)..(535): a, c, t, g, unknown or other
  misc_feature (517)..(535): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcagtgaaggtctcctgcaaggcttcgtggaactccaccctcaccgacgtctatatgcactggtgcgacacggcccctggacaagggcttggagtggagtgggatggatacgaaaccggtaacaggtggtactacaaaactaaattgtagaccaacgaaggtaacggtttcgaggggtccaggggtccaaccgtagtacggaaccgaagggaccacgttaccaatacgaaatacacgacctacgagtacgggaactggacgccgggcgtaggacgaacggtccganagngnnnnnnnnnnnnnnnnnnn

SEQ ID NO: 350983 - DNA, 599 bp, Homo sapiens
  misc_feature: GZ8MTXP01CXKVU.39.87.H10.1.454.CMB.2.raw
  modified_base (377)..(377): a, c, t, g, unknown or other
  misc_feature (377)..(377): n is a, c, g, or t
  modified_base (494)..(494): a, c, t, g, unknown or other
  misc_feature (494)..(494): n is a, c, g, or t
  modified_base (550)..(550): a, c, t, g, unknown or other
  misc_feature (550)..(550): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctaggaactccaccctcaccgacgtctatatgctacgtggtcgcgacgacggccccctaggacgaaggggtcttaggaggtggagtgggatggatacgaaacggtacaggtggtactacaactaaattaangcaacgaaggtaaacgtttcgaaggggcgtagggtacaccgtagtacggaaccgagggacctacggtacctaagtacaaactacgaacgacctaactagtacggggaactggaaacncgaggcgtagagtagtcgtagaccgacgcggtcgtagttatttagttggtgcgagngttagtgagttaacttcgttacgttacgttaaggttcggggtttaaggg

SEQ ID NO: 350984 - DNA, 728 bp, Homo sapiens
  misc_feature: GZ8MTXP01B3O5D.39.87.H10.1.454.CMB.2.raw
  modified_base (197)..(197): a, c, t, g, unknown or other
  misc_feature (197)..(197): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctcctgtctgcatctgtagganacagagtcaccatcacttggccgggcaaggtcagggacaattaaaangtattagctggtancagacaagaaacaggaaactcaaggtcagatctatgatcgccttaccgtaaggttttagggaaacggttcgggggtacccctaagtacgtaaaacggggtttcccaacgggtacgggtcgtaagggtcgggtaaagttccggtaagggggaaaccctaaagggtacttttaccaacctttcctaaccaaaccctactaccaaacccgtacggcccttgggacccggtacccgtttaggaaacggtttattttacggaccttaaaactttatttaacccgtagttaaacttaaacttaaaattttaactttccgtttaacgtccccgtatttacccgtaacggttttccggggaacgggtaacggggtaaccgtaaaggggttagaacggtaaacttaaccgaaaaccggtaacgttggttcggacttccggacctaacccgttcttccgttacttccgttaacgtaaccg

SEQ ID NO: 350985 - DNA, 560 bp, Homo sapiens
  misc_feature: GZ8MTXP01B9FSO.39.87.H10.1.454.CMB.2.raw
  modified_base (248)..(248): a, c, t, g, unknown or other
  misc_feature (248)..(248): n is a, c, g, or t
  modified_base (367)..(367): a, c, t, g, unknown or other
  misc_feature (367)..(367): n is a, c, g, or t
  modified_base (508)..(508): a, c, t, g, unknown or other
  misc_feature (508)..(508): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagccgtggggcctcagtgaaggtctctgcaggcttcnggactcaccctcaccgacgtctatatgctactggtcgacgacgacggcccctggacaagggtctggagtggagtgggatggatacgaacggtaccaggtgtactacaactaaaaattangacaacgtaggtaacgtttcgaggggtcagggtccaacgagtcgacgaggacacgtccaatacaatacagacctacgaggtaggaacgtgacgacgaggctagagtactcgtagacgacgaacggtcgttaggtattgtgngttcggagacgtaatggtaacgttactcgttacgtaacgttggttaaggggg

SEQ ID NO: 350986 - DNA, 615 bp, Homo sapiens
  misc_feature: GZ8MTXP01CROWQ.39.87.H10.1.454.CMB.2.raw
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcacatcacgttcgccgggacaagtcgagggactaattaaaatgtattagcctaggtatcagacaacggaaaccgaagggtaaaactaccgtaaggtcctagatctatgatcgtcctacgtagttaggaaacgtcgggtacccagtacgaggttcagcgcaagtgaatcggaggactagtacttcactcctacacctatccacncnccgtacgcgtactagtaatatttcgaacttaacgttattacctagttaacaaacttaatttactcttacgtcccgtcttccgtacggttacgggacgggtaacgggtaaccgagggttacggaacgtaacgtaaccgttaaaaacggttcgttacgggttcggactaacggtacccacgttattcccggtttgtttaacccc

SEQ ID NO: 350987 - DNA, 594 bp, Homo sapiens
  misc_feature: GZ8MTXP01APB5T.39.87.H10.1.454.CMB.2.raw
  modified_base (358)..(358): a, c, t, g, unknown or other
  misc_feature (358)..(358): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggtgcgacgacggcccctggacaagggcttgagtggatgggatggatcgaaacggtacaggtggtctacgaactaaattangcaacgagtaagtttcgagggcagggtcacctagtcgaccgagggaccacgtaccatacaagtacagaccctagagttagggggaactggagccgaaggctagagtacgtccgtaggaccgaccgccgggtccgttaggttaatttagttggacgggtacgaagggttacgagttaaggtaacgttaaccttcgtttaccgttaacccgtaaggtttcgggggtttaaaccggggg

SEQ ID NO: 350988 - DNA, 588 bp, Homo sapiens
  misc_feature: GZ8MTXP01AT0HL.39.87.H10.1.454.CMB.2.raw
tcagtcgcactagtcacgaccggtgctcgatttagcagtactgcgttgggtttggaggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttctggaatcaccctcaccgacgtctatatgcacgtggttgcgacacggcccctggacaagggcttgaggtggagtgggatggactaccgaaacggtaacgaggtcggtacctaacgaactaattagtcgacacgtaaggtaagtttcgaaggggctaggggtccaaccgagtacggaaccgaggggacctaacggtaccatacaaactacgacgacctaacagtacggaacctaggagaccgaggcgtagagtacttcgacggaacgaaccgaccgggtccgttagtacgttaagttgttggacggaagagtgtgacgttacgttctttcgttaacgg

SEQ ID NO: 350989 - DNA, 515 bp, Homo sapiens
  misc_feature: GZ8MTXP01D80C4.39.87.H10.1.454.CMB.2.raw
  modified_base (362)..(362): a, c, t, g, unknown or other
  misc_feature (362)..(362): n is a, c, g, or t
  modified_base (455)..(455): a, c, t, g, unknown or other
  misc_feature (455)..(455): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggagtgggatggatcgaaccggtacagtggtctacgaaacaaattntgacaacgagtaagtttcgaggggtcagggtcacagtcgaccagggacacgtcatcaatacagcctagatggaactgagcgaggctagacgtntctgacgaacgacggcgtgttatagtgttgcgagaagatgagtcttcttcgttcgttaag

SEQ ID NO: 350990 - DNA, 515 bp, Homo sapiens
  misc_feature: GZ8MTXP01D0UVO.39.87.H10.1.454.CMB.2.raw
  modified_base (364)..(364): a, c, t, g, unknown or other
  misc_feature (364)..(364): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (480)..(480): a, c, t, g, unknown or other
  misc_feature (480)..(480): n is a, c, g, or t
tcagtcgcactagtcacgaccggtgctcgatttagcagtactgcgttgggtttggggagcatcacccacgcaaccacatctgtcctctagagaatccctcgagagctccgttcctcaccatggactggacctggaggatcctcttcttggtggcagcagccacaggagcccactccccaggtgcagctggtgcagtccgggactgaggtgaagaagcctggggcctcagtgaaggtctcctgcaaggcttctggaatcaccctcaccgacgtctatatgcactggtgcgacgcggccccgtggacgaagggcttggagtggagtgggatggatcgaaacgacagtggtctacaaacaaattgtnacactaagtagttcgagggcagggcacatgaccaggacacgtacagcaaatacagcccgtaagagtagangagcgngacgagagtntgacgacgaacncgttntnttagtgtgagngagtaagtagtgacgtacttacgttcgttaacgtg

SEQ ID NO: 350991 - DNA, 560 bp, Homo sapiens
  misc_feature: GZ8MTXP01BKUG5.39.87.H10.1.454.CMB.2.raw
  modified_base (225)..(225): a, c, t, g, unknown or other
  misc_feature (225)..(225): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtgggcctnagtgaaggtctcctgcaaggtcttcgtggaactcaccctcaccgacgtctatatgcactggtgcgacacggcccctaggacgaagggcttgagtggagtgggatggatcgaaaccggtacagtggtcncaaacaaattngacacgagtaagttcgagggtcgaggtcacgagtcgacgaggacacgtcagtacaatacacgccctaagacgttaggaacctgaacgcgaggcgtagagtcgtacgagaacggaacgtacggccgttagttagttaagttcgttaggcgttaggaagtagtaaggtacgtacgttaccttaagttaacgttaaggg

SEQ ID NO: 350992 - DNA, 541 bp, Homo sapiens
  misc_feature: GZ8MTXP01A43A7.39.87.H10.1.454.CMB.2.raw
  modified_base (361)..(361): a, c, t, g, unknown or other
  misc_feature (361)..(361): n is a, c, g, or t
  modified_base (453)..(453): a, c, t, g, unknown or other
  misc_feature (453)..(453): n is a, c, g, or t
  modified_base (499)..(499): a, c, t, g, unknown or other
  misc_feature (499)..(499): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaactcaccctcaccgacgtctatatgcactggttgcgacacggcccctggacaagggcttgagtggagtgggatggatcgaacggtacagtggtcacaaacaaattngcacagtaagttcgagggcagggtcacagtgaccagggacacgtcatacaatacagacctacagtaggaactcgagcgaggcgtagaaggtntacgtacggacgaacgaccgggttccgtgttaaagttgtaggttgnggttagaaggtatggacgttacttacttcgttaacgttaagg

SEQ ID NO: 350993 - DNA, 612 bp, Homo sapiens
  misc_feature: GZ8MTXP01BARPG.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagccgtggggcctcgagtgaaggtctcctgcaaggtcttcgtggttacacctttacaactatggtatcgtaggttgggtgcgacgacggcccctggacgaagggcttggagtggagtgggatggatcgagcgtacttaaccgaagtcggtaacaaccgaactaaaaactagtcgaccaacgaacgaaccctcgaacggggacacgacgtccaaccgatacgaaccaacgaacgaccacacgtaccaacgacacgaccggacctacgagtcggacctggaacgacgccgtagacgtactcgacgaccgaaccgacggttccgttagttacgttacgtgttacggcgttaggaacggtaggtaacgggtaatttcggttacgtaaccgttcggttaacccg

SEQ ID NO: 350994 - DNA, 602 bp, Homo sapiens
  misc_feature: GZ8MTXP01AULRT.39.87.H10.1.454.CMB.2.raw
  modified_base (236)..(236): a, c, t, g, unknown or other
  misc_feature (236)..(236): n is a, c, g, or t
  modified_base (490)..(490): a, c, t, g, unknown or other
  misc_feature (490)..(490): n is a, c, g, or t
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagccgtgggcctcagtgaagtctccgnagctctgatcacctcacgacgctatatgcacgtggttggcgacgaacggccccgtcggacgaacggcgttgaggtggagtgggagtaggagtaccgaaacgggtaacgtacggtggtctacaacaaattaaactgaacacaagtaagttacgagggcgagggtcaccagtcgaaccgacgggacacccgtacatactaaactacgacgtaccgtaactagtacgggggaaccgtggaacgccgaaggtaccgtnaaaggacttcgacgacgaaccgaccgggtcgttggttaaatttagttggacggcgaagagttacttggagttaaccttcgttcttaacggttgttccgggggtttaaagggg

SEQ ID NO: 350995 - DNA, 584 bp, Homo sapiens
  misc_feature: GZ8MTXP01AZZMY.39.87.H10.1.454.CMB.2.raw
  modified_base (247)..(247): a, c, t, g, unknown or other
  misc_feature (247)..(247): n is a, c, g, or t
  modified_base (539)..(539): a, c, t, g, unknown or other
  misc_feature (539)..(539): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtggggcctcagtgaaggtctctgcaaggcttcnggaatccaccctcaccgacgtctatatgcactggtgcgacgacggcccctggacaagggcttgagtggatgggatggatcgaaacggtaaccaggtggtctacgaactaaaaattatgacaacgaaggtaagtttacgaggggcaggggtaccaaccgatacgaaccgacgggaaccaccgtacaactacaaacgtaaccgacgtacctaacgacgtagggaaactggaacgcgacggtcgagaagactccgtagaccgacgaacggtcggttagttagttagttggtgagngttagtaatgtaacgtacctgttactaacgttaaggttaaggggg

SEQ ID NO: 350996 - DNA, 593 bp, Homo sapiens
  misc_feature: GZ8MTXP01DI4EO.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagagccgtggggcctcgagtgaaggtctcctgacaaggtcttcgtggaactccaccctcaccgacgtctatatgctacgtggttgcgacgacggcccctggaacaagggtctgagtggagtgggatggataccgaaacggtactaggtgtacctacgaaaactaaattgtgacaacgtaaggttaaacggtttcgaaggggccgtacgggtaccaaccgtagtacggaaccgaagggacctacgtaccaatacaaatacacgtaccctaagagttaggaactggaagcgaggctagagtatacgcgacgaacgcggttacgttgttacgtttagtgttgcgaggaagtagtggtactcttcgttaaccgttaagtttaaggg

SEQ ID NO: 350997 - DNA, 530 bp, Homo sapiens
  misc_feature: GZ8MTXP01EDWGL.39.87.H10.1.454.CMB.2.raw
  modified_base (222)..(222): a, c, t, g, unknown or other
  misc_feature (222)..(222): n is a, c, g, or t
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (430)..(430): a, c, t, g, unknown or other
  misc_feature (430)..(430): n is a, c, g, or t
  modified_base (455)..(455): a, c, t, g, unknown or other
  misc_feature (455)..(455): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagagcctggggcctnagtgagtctcctgcaaggcttnggaatcaccctcaccgacgtctatatgcactggtgcgacncggcccctggacaaggcttggagtggatgggatggatcgaaacggtaaccaggtggtactacaactaaaaattatgacaacgagtaagtttcgaggggcagggtaccacatcgacgagggacacgtccagtacaatacagacctanacggtagaactgagcaggctgacgntcagacgacgaacgtcgttagtacttagtgtgacgagagtaatgtaagttactcgttactaacgttgttaagggg

SEQ ID NO: 350998 - DNA, 591 bp, Homo sapiens
  misc_feature: GZ8MTXP01DBDA0.39.87.H10.1.454.CMB.2.raw
  modified_base (550)..(550): a, c, t, g, unknown or other
  misc_feature (550)..(550): n is a, c, g, or t
  modified_base (559)..(559): a, c, t, g, unknown or other
  misc_feature (559)..(559): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcatcgagtgaaggtctcctgcaaggcttcgtggaactccaccctcaccgagtctatatgcactggtgcgacacggccctaggacaagggcttggaggtggagtgggatggatacgaaaccggtaacaggtggtactacgaaaactaaattgtacgacaaacgtaaggtaacggtttacgaggggactaggggtacaaccgtagacgaaccgaaggggaacacgttaccaagttacaaactacgaacgtaccctaagagttaggaaacctggagccgaggcgtagaagtctcacgacgaacgacggcttagttagtttagtggttagngaaggtaanatggtaactacttcttaacgttaagttaaggg

SEQ ID NO: 350999 - DNA, 591 bp, Homo sapiens
  misc_feature: GZ8MTXP01D9Y9S.39.87.H10.1.454.CMB.2.raw
  modified_base (386)..(386): a, c, t, g, unknown or other
  misc_feature (386)..(386): n is a, c, g, or t
  modified_base (551)..(551): a, c, t, g, unknown or other
  misc_feature (551)..(551): n is a, c, g, or t
  modified_base (573)..(573): a, c, t, g, unknown or other
  misc_feature (573)..(573): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactccccaggtgcagctggtgcaggtccgggactgaggtgaagagccgtgggcctcagtgaggtctcctgacaggtctcgtaggaatccaccctcaccgacgtctatatgctacgtggtgacgacgacggccccgtagggacgaagggtcttaggagtaggagtgggtatcggagtacgaaaccggtacaggtggtactacgaaaactaaattntcgacaacgtagtaacggtttacggagggacgtacgggtacaacgagtcggaccgaagggaacctacgtaccatacaaacgtacacgtaccctaggaagtacggaaatcggagccgagcgtagagtatacgtcgacgaacgtcggttcgtagttagttagtgcgngttagaagtagtgtagtacttnttaacttaacgttaaggg

SEQ ID NO: 351000 - DNA, 584 bp, Homo sapiens
  misc_feature: GZ8MTXP01DKT3G.39.87.H10.1.454.CMB.2.raw
  modified_base (364)..(364): a, c, t, g, unknown or other
  misc_feature (364)..(364): n is a, c, g, or t
  modified_base (479)..(479): a, c, t, g, unknown or other
  misc_feature (479)..(479): n is a, c, g, or t
  modified_base (551)..(551): a, c, t, g, unknown or other
  misc_feature (551)..(551): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacgacggcccctaggacaagggcttgagtggatggatggatcgaaacggtacagtggtctacgaaactaaattgngtaccaaacgaggtaaacgtttcggaggggtacgacgggggttaccaaccgtaagtcggaaacccgagggggaacctacggtaccaactacaaactaaccgacgtacccctaaanacgttagggaaacctaggagcggtaagcgtagagtacgacgtagaacgcgaacgccgtgttattagtgttgngagaagatgtacgtattcttcttaagttaaggg

SEQ ID NO: 351001 - DNA, 507 bp, Homo sapiens
  misc_feature: GZ8MTXP01DKP9A.39.87.H10.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (391)..(391): a, c, t, g, unknown or other
  misc_feature (391)..(391): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccggnaagtcagggcattaaaangatttagctgtancagcaagaaacagggaaactctaaggtccngatctatgatgcctcagtttggaaagtggtccatcaaggttcagtgcagtggaatcgtgggactagatttcactctcacatcaccagcctgcgacctagtaatgtttanactaacttattactgtactaaacttaatttaattcttactccacttcacgtttcggacggaggtacaaggtgagattacgaaacgattgttgctgcaacctgtcttacgtcttctc

SEQ ID NO: 351002 - DNA, 615 bp, Homo sapiens
  misc_feature: GZ8MTXP01EDAVD.39.87.H10.1.454.CMB.2.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
  modified_base (596)..(596): a, c, t, g, unknown or other
  misc_feature (596)..(596): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttcgacccagtctccatccctccctgtctgcatctgtagganacagagtcacntcactgccggganaagtcaggactaaattaaaatgtattagcctggtancagcaagaaaccaaggtaaactccgtaaggtcctagatctatgatcgcctacgtaggtttaggaacggtcgggtaccctagtcgaaggttccaggcggacgaggtaggtaacgtcggtaaggggactaagtactttccaccttacctacaccctactccgaaaccctcggccgtcggccggtaccttaggtaacttatttacgaacttaacgtttacttacgtataactaaacttaatttactcgttactccgtacttacgtacgttcggggacggtacggaaccgtaagggtagaacgtaacttaacgaaacgtacgttgcggctcgacaacgtntcttcttccttcgtaaccc

SEQ ID NO: 351003 - DNA, 587 bp, Homo sapiens
  misc_feature: GZ8MTXP01EWMUY.39.87.H10.1.454.CMB.2.raw
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (372)..(372): a, c, t, g, unknown or other
  misc_feature (372)..(372): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctnagtgaaggtctcctgcaaggcttcgnggaatccaccctcaccgacgtctatatgcactggttgcgacacggcccctggacagggcttggagtgggagtgggatggatacgaaacggtaaccaggttggtactacaaactaaaaattanggtacaaacgtaggtaaagttttccgaagggggtctaacggggtaccaaccgagtacggaaccgacggggaacctaacccggtaccaacgtaccaaattaccgaacgtacctaacgaggtacggaactgagcgagcgtagagactcgagacgacgcggtcgttagtattagtgtgcgagagaatgtaagtactgttactaagttaaggttaaggg

SEQ ID NO: 351004 - DNA, 530 bp, Homo sapiens
  misc_feature: GZ8MTXP01EW5KD.39.87.H10.1.454.CMB.2.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (494)..(494): a, c, t, g, unknown or other
  misc_feature (494)..(494): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagccgtggggcctnagtgaggtctcctgcaaggcttcnggaactccaccctcaccgacgtctatatgcacgtggtcgcgacgacggcccctaggacgaagggcttggaggtggagtgggatggatcgaaggtacaggtgtctacaactaaaattngacanagtagttcgagggctacgggtacacgagtacgacgaggacacgtcatacaatacagacctacgagtacggaactgagacgaggctagagatcgagaccgcgaacgtcgttagtattagtgtagngagagaatgtaatactcttatcgttaagttaagggg

SEQ ID NO: 351005 - DNA, 708 bp, Homo sapiens
  misc_feature: GZ8MTXP01DCE8C.39.87.H10.1.454.CMB.2.raw
  modified_base (250)..(250): a, c, t, g, unknown or other
  misc_feature (250)..(250): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagagccgtggggcctgagtgaaggtctctgcaggtctngatcaccctcaccgacgtctatatgctacgtggtcgacgacgacggtcccctaggacgaagggtcttggagtgggagtgggatggatacgaaacggtacgaggtcggtactacgaaaactaaattgtagactaaacgtaaaggtaaacggtttaccggaaggggtccgaacggggttaccgaacccgtaagtaccggaaacccggtaacgggggaacctaaccggttaccaaacgttacccgaaaattaccgaaacgtacccctaaaggtaaccgttagggaaaccgtggaacgtcgaacggacctaagggtaaccgagttaccgacggtaaccggaaaccggtaccgggttccggtttaaagttaacgttttaggtggttacgggacgttaagggtaagtaacggtaacgttaacccgttaccccgtttaggttaaccgttgggttttaacgggggg

SEQ ID NO: 351006 - DNA, 686 bp, Homo sapiens
  misc_feature: GZ8MTXP01BC990.39.87.H10.1.454.CMB.2.raw
  modified_base (369)..(369): a, c, t, g, unknown or other
  misc_feature (369)..(369): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttctggaatcaccctcaccgacgtctatatgcactggttgcgacacggcccctggacaagggcttgagtggagtgggatggatacgaaaccggtacaggtggtctacgaaactaaattgngacacgtaagtaagttttcgaggggtcgacggggtacaaccgagtacggaaccgaagggaccaccggtaccaacttacaaactacaacgtaccctaacgaacgttacgggaaaccttacggaacgtacccggaaggtccgttaaggaaacggtacgttaccggttacggtaaacccgggaacccggtaaccggggttaccccgggttaggtttaaaccgttttaaggtttcgggttacggttacgggaaaggtaaggtaacggttaaggtaacgggttacctttaccgtttaaccgtttaaccgtttttaaaggggg

SEQ ID NO: 351007 - DNA, 625 bp, Homo sapiens
  misc_feature: GZ8MTXP01EZ84U.39.87.H10.1.454.CMB.2.raw
  modified_base (251)..(251): a, c, t, g, unknown or other
  misc_feature (251)..(251): n is a, c, g, or t
  modified_base (485)..(485): a, c, t, g, unknown or other
  misc_feature (485)..(485): n is a, c, g, or t
  modified_base (572)..(572): a, c, t, g, unknown or other
  misc_feature (572)..(572): n is a, c, g, or t
  modified_base (587)..(587): a, c, t, g, unknown or other
  misc_feature (587)..(587): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctcttcttggtggcagcagccacaggagcccactcccaggtgcagctggtgcaggtccgggactgaggtgaagaagccgtggggcctcagtgaaggtctcctgcaggcttcnggactcaccctcacccgacgtctatatcgacctacgttggtcgccgacgtacccggccccgtagggaacgaagggtctaggaggtaggaggtagggagtaggacgtaacgtaaaccggtacgtaggttacgtactaactaaaactaaattcgagaccaagtaagtacgttacgggagggtacgacggtaccaacggtacgtaacggaacggaccgtaactccaactactaaacnctaacgacacgtaaggtacgaacgagtcgaacggcgtacggacgaagaccgtagtacaacggcaacggtcgttactagtttacgcgngacgttaggataagnggtaacttcggtaccttagttaacgaaggtttaagggg

SEQ ID NO: 351008 - DNA, 577 bp, Homo sapiens
  misc_feature: GZ8MTXP01AWP4U.39.87.H10.1.454.CMB.2.raw
  modified_base (251)..(251): a, c, t, g, unknown or other
  misc_feature (251)..(251): n is a, c, g, or t
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagaagcctggggcctcagtgaaggtctcctgcaaggcttcnggaatcaccctcacccgacgtctatatgcacgtggttgcgacacggcccctggacaagggcttgagtggagtgggatggatcgaacggtanagtggtctcgaaacaattntgacanagtaagtttcagggtcagggtcaccatacgaccagggaccacgtcatacaatacagacctaacgagtacggaacgtgacgccgagccgtagaagacgtcgtacggaaccgaacgtcggttaccgggttattaacggtttatttgggaccgttacggaaggtaaggtagtaaggtaacgtaccttacgtttaacttaaccgttttaagggg

SEQ ID NO: 351009 - DNA, 711 bp, Homo sapiens
  misc_feature: GZ8MTXP01DGW7X.39.87.H10.1.454.CMB.2.raw
  modified_base (228)..(228): a, c, t, g, unknown or other
  misc_feature (228)..(228): n is a, c, g, or t
tcagtcgcactagtcacgaccggtgctcgatttagcagtactgcgttggggtttgggggcaggagtcagacccactcaggacacagcatggacatgagggtccccgctcagctcctggggcttctgctgctctggctcccaggtgccagatgtgccatccagttgacccagtctccatcctccctgtcctgcatctgtaggagacagagtcaccatcacttgccgggnaagtcagggacaattaaaatgtattagcctggtatcagacaacgaaaccgagggaaactcctaaaggtcctagatctatagatcgacccttaccgtaaggtttagggaaacggttcgggggtaccccaagttacccccgaaaggggtttacgagggtcccgggtaccgtaaagggtgggtaacgttcgtacgggggaacctaaggtaacttttcaaactcctacctaccacttaccaccgtacgtcccgttaggccggtaccttaggtaaagttacttttcgaactttaaaccgttttagtttaactaggttaaaccaaactttaaattttaaacgttctttaacttcccggtacttaccgttaaccggtttccggggaacgggaacgggtaaccgaaaggggttcgaaaggtaactaccgttaaaaaccggttcttagggttcgggacttcggacctaacgttacttcggttcgtttaaccc

SEQ ID NO: 351010 - DNA, 554 bp, Homo sapiens
  misc_feature: GZ8MTXP01DQ352.39.87.H10.1.454.CMB.2.raw
  modified_base (461)..(461): a, c, t, g, unknown or other
  misc_feature (461)..(461): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagaagcctgggcctcagtgaggtctctgcaaggcttctagatcaccctcaccgacgtctatatgcatggttgcgacaggcccctggacaagggcttagagtggagtgggatggatacgaaacggtacagtggtactacgaactaaattaactgcactaaggtaaacgtttcgaagggtacgagggtcaaccgatcgaccgagggacacgtaccatacaactacagacctacagtgggaactagagacgagctaganatctagacgacgtacggcgttgttattagttgagcggttaagcgttaagtggtaactctttctacgttacttaagggtttcgggtttaagggg

SEQ ID NO: 351011 - DNA, 551 bp, Homo sapiens
  misc_feature: GZ8MTXP01D5GFG.39.87.H10.1.454.CMB.2.raw
  modified_base (370)..(370): a, c, t, g, unknown or other
  misc_feature (370)..(370): n is a, c, g, or t
  modified_base (476)..(476): a, c, t, g, unknown or other
  misc_feature (476)..(476): n is a, c, g, or t
  modified_base (505)..(505): a, c, t, g, unknown or other
  misc_feature (505)..(505): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcagtgaaggtctccgtgcaaggcttctaggaactccaccctcaccgacgtctatatgcacgttggtgcgacacggcccctggacaaggggcttggaggtggagtggatggatacgaaacggtaacagtggtactacaactaaattanagcaacaggtaacgttcgaggggtcagggtcacgagtcggacgagggacacgtacaatacaactacacgctaacgagtagggaactgagcgtagcgtagagatcgngacgcgcggctgttatagttgacgtgagngttacgtaaggtacttcgtacgttattacgttgttgggttaacggg

SEQ ID NO: 351012 - DNA, 583 bp, Homo sapiens
  misc_feature: GZ8MTXP01DYP20.39.87.H10.1.454.CMB.2.raw
  modified_base (223)..(223): a, c, t, g, unknown or other
  misc_feature (223)..(223): n is a, c, g, or t
  modified_base (258)..(258): a, c, t, g, unknown or other
  misc_feature (258)..(258): n is a, c, g, or t
  modified_base (419)..(419): a, c, t, g, unknown or other
  misc_feature (419)..(419): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcacatcacttggccggganaagtcagggactaattaaaatgtattagctggtancagacaagaaacaggaaactcgtaagtcctagatctatgatcgtcctacgtaggtttaggaaaggtcgggtacctatcgaaggttcccgaggcgagagtggaactcgtgggactagtactttcactctacaccatcaccagccgtgcgtacctagtaagtntttacacttaacttatactagtaactaaattaagtttaacttacttactccgtacttacgtccgttacgggacggtaacgggaccgaagggtggaagtaacttaacgaaacgtacgttggttcggttctaacgacaaccttagtccttattccttcgtaacccg

SEQ ID NO: 351013 - DNA, 662 bp, Homo sapiens
  misc_feature: GZ8MTXP01B837B.39.87.H10.1.454.CMB.2.raw
  modified_base (575)..(575): a, c, t, g, unknown or other
  misc_feature (575)..(575): n is a, c, g, or t
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcgacggtccgggactggaggtagaaaggaacgccgtgggggcctcgaggtgaacggtctccgtgacaaggtcttcgtggaactccaccctcgaccgacgtactatatcgctagttggttcgccgaccgaccggtcccccgtaggaacgtaacgggggtcttagggaggttgggagtagggggtagtagggactacgaaacgggtaaccctggttcggtacctacgaaactaaaatttacgtcgaacctaacgtaaggttaacggtttcgacgggggtacaaggggtccaaccgtaaggtacggaaccggtaagggacctaaccggtaccatacgaaactacgacgacctaacgagggtaggaacgtggacgacgaggtcgagaacgngtacgtacgaacgtcgaacggtcgttagttacgttgtggagacggttagagtaagtcgtaatctcgttagtaagttcggttaagggg

SEQ ID NO: 351014 - DNA, 684 bp, Homo sapiens
  misc_feature: GZ8MTXP01EG3DV.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccggactggaggtgaagaagccgtggggcctcgagtgaaggtctctgcaaggcttcgtagaactccaccctcaccgacgtctatatgctacgtggttcgcgacgacggccccctaggacgaagggtcttaggaggtggagttgggatggactacgaaacggtacaggtggtactacgaactaaattagtacgcgtactaaaggtaaacgtttcgacggggtacgtaggggtacccaacgtagtacggaaccgaaggggaccacggtacccaagtacaaacgtacacgtaccctaagacggttacggggaaaccttagggaacgtcgacgggtctaacggagtacgttcgtaacgggaaccgaccggaaccgggtaaccggtttagttaagtttacggtttaggacggtacgggaaggttagttacggttaagtaaacggttcctttacgtttacggtttacgttaaggggttttccgggggttttaaagggg

SEQ ID NO: 351015 - DNA, 559 bp, Homo sapiens
  misc_feature: GZ8MTXP01EC3E3.39.87.H10.1.454.CMB.2.raw
  modified_base (253)..(253): a, c, t, g, unknown or other
  misc_feature (253)..(253): n is a, c, g, or t
  modified_base (513)..(513): a, c, t, g, unknown or other
  misc_feature (513)..(513): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcgagtgaaggtctcctgcaggtctgnggatcaccctcaccgacgtctatatcgctacgtggtgcgacgacggcccctaggaacgaagggtcttaggagtggagtgggatggatacgaacgtacgagtgtctacaaactaaattgagacacgagtaagttcgagggtcagggtcacgagtacgacgagggacacgtacagtacaaatacatacccagagtaggaactaggagcgaggctagagtagtcgtacggacgaacggtaccggccgttagttagtttagtgngttacggagtaagagtaagtactcttcttaacgttaagtttaaggg

SEQ ID NO: 351016 - DNA, 582 bp, Homo sapiens
  misc_feature: GZ8MTXP01ASYU1.39.87.H10.1.454.CMB.2.raw
  modified_base (377)..(377): a, c, t, g, unknown or other
  misc_feature (377)..(377): n is a, c, g, or t
  modified_base (533)..(533): a, c, t, g, unknown or other
  misc_feature (533)..(533): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagccccactcccaggtgcagctggtgcagtccgggactgaggtgaagagccgtggggcctcagtgaaggtctccgtgcaaggcttctggaactccgaccctcacccgacgtctatatgcacgtggttgcgacacggcccctggacgaagggctttggagtggagtgggatggactacgaaccggtacaggtcgtactacgaaactaaattntgacacgagtaagtttcgagggcgagggtcaccgatcgacgaggacacgtacatacaatacacgacctacgagtacgggactaggacgcgaggctaggactagttcgacggaacgaaccgtaacgggttccgttagttacgtttaagtcggttggngaggtaagtagtcggtaacgttcttaccgtttcgttaacgtttaagggg

SEQ ID NO: 351017 - DNA, 658 bp, Homo sapiens
  misc_feature: GZ8MTXP01CC5YB.39.87.H10.1.454.CMB.2.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacgttggccggnaagtcgagggactaattaaaatgtattagcctggtancagacaagaaaccgaaggaaactccgtaaggtcctagatctatgatgtacctcgtaggtttaggaacggttcggggtaccctagtcgtaaggttcccaggcggctaggtggtaacttcgtggggactaggttactttacactctaccacctataccaccgacgtcccgtggaccggtaccttaggtaagttacttttcgaactttaaacgtttactttaaccgttcggttaaacttaaactttaaactttttaacttacctttaacgttcccgttaccttaccgttacggttttaccggggacgggtaacgggaaccgtaaaggggtggaacgtaacttaacgaaacgtagttggttcgcgtaacgcctaactacttcgttacttcgttctaaccc

SEQ ID NO: 351018 - DNA, 575 bp, Homo sapiens
  misc_feature: GZ8MTXP01D1EXH.39.87.H10.1.454.CMB.2.raw
  modified_base (539)..(539): a, c, t, g, unknown or other
  misc_feature (539)..(539): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcgagtgaaggtctcctgcaaggtctcgtaggaactccaccctcaccgacgtctatatgctacgtggttgcgtacgacggcccctaggaacaagggtcttggagtggagtggatggactacgaaacggtacagtcgtctacgaaacaaattgcgactaacgagtaagttcgagggtacgagggtcaacgtagtacgaccgtaaggactacgtacaagtacaaatacagaccctagacgtaggaactagagcgaggtcgtagacgtactcgtacgacgaagtcggacgttgttagttagtgttaggcaggtaanagtgtacgttacttactttaaccgaagtttaagggg

SEQ ID NO: 351019 - DNA, 663 bp, Homo sapiens
  misc_feature: GZ8MTXP01AYXCU.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggatgaggtgaagagccgtggggcctcgagtgaaggtctcctgcaggcttctggaactcaccctcacccgacgtctatatgctacgtggtgcgacacggcccctggacaagggtcttggagtgggatggggatggatacgaacggtacaggtggtctacaactaaaattacgtgacaacgaagtaagttttccgaggggacgtacggggtaccaacgtagtacggaaccgacgggaactaccggttacacttacaaattaccaacgaccttaacgacggttacggaacgtacggagacgacggctaggaagacttaccgagtaaaccggaaccgtaaccgggtaccggttagttaaacgtttaggtttacggtcggttaccggaacggttaaacggtaacgttagggtaaccgtttaaccgtttccgtttaacccgttaaggtttaaccggggtttttaaacgggggg

SEQ ID NO: 351020 - DNA, 580 bp, Homo sapiens
  misc_feature: GZ8MTXP01DFATS.39.87.H10.1.454.CMB.2.raw
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (364)..(364): a, c, t, g, unknown or other
  misc_feature (364)..(364): n is a, c, g, or t
  modified_base (556)..(556): a, c, t, g, unknown or other
  misc_feature (556)..(556): n is a, c, g, or t
  modified_base (561)..(564): a, c, t, g, unknown or other
  misc_feature (561)..(564): n is a, c, g, or t
  modified_base (566)..(568): a, c, t, g, unknown or other
  misc_feature (566)..(568): n is a, c, g, or t
  modified_base (570)..(580): a, c, t, g, unknown or other
  misc_feature (570)..(580): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagagccgtggggcctnagtgaagtctctgcaggcttcgnggaactccaccctcaccgacgtctatatcgccacgttgggtcgacgaccgacggcccctaggggaacctaaggggcttaggagtggagtggatggactacgaaaccggtacnggtcgtcacgaaaacttaaattcgacgacaacgtaaggtaagtttcgggagggtacacggggttaccaaccgagtacggaaccgacgggggaacctaaccggtacaacgtaacaaacttaccgaacgtacccttaagacgtacgggtaaaccgtggaacggccgggtacgtacggaacgaacggcgacgaanggaannnngnnngnnnnnnnnnnn

SEQ ID NO: 351021 - DNA, 544 bp, Homo sapiens
  misc_feature: GZ8MTXP01EN6OO.39.87.H10.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (254)..(254): a, c, t, g, unknown or other
  misc_feature (254)..(254): n is a, c, g, or t
  modified_base (398)..(398): a, c, t, g, unknown or other
  misc_feature (398)..(398): n is a, c, g, or t
  modified_base (516)..(516): a, c, t, g, unknown or other
  misc_feature (516)..(516): n is a, c, g, or t
tcagtcgcactagtcacgaccggtgctcgatttagcagtactgcgttgggtttgggggagtcagacccactcaggacacagcatggacatgagggtccccgctcagctcctggggcttatgctgctctggctcccaggtgccagatgtgccatccagttgacccagtctccatcctccctgtctgcatctgtagganacagatcaccatcacttgccggnaagtcagggcaattaaaatgtatttagctggtancagcaagaaaccagggaaactccgtaagtcctagatctatgatgcctctagtttaggaagtgggtccatcgaagtcagcggacaggtgaatcgtgggacagtattcactctcaccatcaccagctgcgtactgtaatagtttanactaacttatacttagtactaaacttaaatttaactcgttaactcgtctactacgttcgggacggtacgggacgaagggtggaggaacttaacgaaacgtaacgttgttcggctaacncctaacgattccgttattccttctaacc

SEQ ID NO: 351022 - DNA, 551 bp, Homo sapiens
  misc_feature: GZ8MTXP01AZWZM.39.87.H10.1.454.CMB.2.raw
  modified_base (342)..(342): a, c, t, g, unknown or other
  misc_feature (342)..(342): n is a, c, g, or t
  modified_base (366)..(366): a, c, t, g, unknown or other
  misc_feature (366)..(366): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcgagtgaagtctcctgcaggcttctggaatcaccctcaccgacgtctatatgcactggttgcgacacggcccctggacgaagggcttggagtggagtggatggatcgaaccggtaanaggtggtactacgaaactaaattntgacaagagtaaggtttcgagggtcaggggttacaaccgagtacggaaccgaggggacacggtaccaactacaactaacacgacctacagtaggactggagccgagcgtagacgtntcgngacgcgacgttcgtgttacgttagtgttgcgagaagtatgtacgtcttcttaacgttgttaaggg

SEQ ID NO: 351023 - DNA, 796 bp, Homo sapiens
  misc_feature: GZ8MTXP01CCLJ6.39.87.H10.1.454.CMB.2.raw
  modified_base (219)..(219): a, c, t, g, unknown or other
  misc_feature (219)..(219): n is a, c, g, or t
  modified_base (255)..(255): a, c, t, g, unknown or other
  misc_feature (255)..(255): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagatcaccatcacttgcggnaagtcaggactaattaaaatgtatttagctaggtancagacaagaaaccagggaaacctccgtaaggtctagatctatgatcgcctcgtaaggtttaggaaacggttcgggtaccccaagtaccgtaaagggtttcccgaacgggtcggacgtaagggtcgggtaaaacgttccggttaagggggaacctaaagggttaactttttacccaaccctttacctacccaaacccggtacttacccaaacccgtacggccccgttgggaccccgggttaaccttagggttaaacgtttatttttacggaaacctttaaaaccttttaagtttaaccccgttaggtttaaacttaaaaccttttaaattttttaaactttcccggtttaaacgttccccgttactttaacccggttaccgggttttaccgggggaaccggggttaaacggggaacccgttaaagggggttagggaaactaaaccgttaaaccgaaaaaacgggtccgttgggttacgggacccgtttaacgacccgttaaaccttcgtttccgttaccgttaaccgtttaaccgtaacccg

SEQ ID NO: 351024 - DNA, 571 bp, Homo sapiens
  misc_feature: GZ8MTXP01BP5CU.39.87.H10.1.454.CMB.2.raw
  modified_base (251)..(251): a, c, t, g, unknown or other
  misc_feature (251)..(251): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtagaagaacgccgtggggcctgagtgaaggtctctgcaggcttnggaatccacctcaccgacgtctatatgctacgtggtcgcgaccgcggcccctaggacgaaggggtcttaggaggtgggagtgggatggatacgaacggtacnggtgtcacataaaattngacagagtacgttcgagggcgacggtacacagtacgacgaggacacgtcagtacaatacagacctaacaggtagaacgtgacgacgagcgtagagacgttcgacgaccgtacgaacggtcgttagttattaggtgtacggacgttaggttagtaagtagtaagttacccttcgttacgttaacgttaaggtttaacggggg

SEQ ID NO: 351025 - DNA, 550 bp, Homo sapiens
  misc_feature: GZ8MTXP01E0HFW.39.87.H10.1.454.CMB.2.raw
  modified_base (364)..(364): a, c, t, g, unknown or other
  misc_feature (364)..(364): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcacccctcaccgacgtctatatgcactggttgcgacacggcccctggacaagggcttgagtggatgggatgggatacgaaccggtaacagtggtctacaaacaaattntgacacagtaagtttcgagggcagggtcacatgacagggacacgtaccatacaatacagtaccctaaagagtacggacagacgcgagagtagacgtactacgacgaacgaacgacggttcgtagttagttagtggacgcggagaagtagtaacgtacgttacttacgttaacgttaacgttaaggg

SEQ ID NO: 351026 - DNA, 735 bp, Homo sapiens
  misc_feature: GZ8MTXP01BLJC9.39.87.H10.1.454.CMB.2.raw
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (564)..(564): a, c, t, g, unknown or other
  misc_feature (564)..(564): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttcgacccagtctccatccctccctgtctgcatctgtaggagacagagtcacatcacgttgccggganaagtcgagggactaattaaaatgtattagctaggtancagacaagaaaccgaaggaaactccgtaagtctagatctatgatcgccttacgtaggtttaggaaacggttcgggtacccaagtacgtaaggttccaggcggtacaggtggtaactcggtaaggggactaggtactttccgacttcctacgtacccactaccaaccgtacgtcccgttggacccggtaccgttaaggttaaacgttcgttttaacgaacttaaaactttaacgtttaaccgttacgttaaacttaaaacttttaaacgttttaactttaccgttaccgttaaccccggttnttaacccggtttacggtttaccgggggaaccgggtttaaacgggaacccggtaaaagggggttggaaaccggttaaacgttaaaccggtaaaaaaccggtgttcggggttaacgccgttaacggaccctaacctttaacgtccgtttaacttcccgtttaacctaaccccg

SEQ ID NO: 351027 - DNA, 663 bp, Homo sapiens
  misc_feature: GZ8MTXP01BJNGB.39.87.H10.1.454.CMB.2.raw
  modified_base (220)..(220): a, c, t, g, unknown or other
  misc_feature (220)..(220): n is a, c, g, or t
  modified_base (370)..(370): a, c, t, g, unknown or other
  misc_feature (370)..(370): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccggactgaggtgaagagcctgggcctnagtgaggtctcctgcaggcttctggaatccaccctcaccgacgtctatatgctacgtggttgcgacgacggcccctggacaagggcttgaggtggagtgggatggatacgaaacggtaactaggtggtactacgaaactaaagtttaaangaaccaaacgtaaagggtaaacgttttccgaagggggtccgtaacggggtaccaacccgtaagtacggaaacccgaacggggacccaaccgttacccaattaccaaataccgaacgaccctaaataacgttacggggaacttaggacgcgaaggtccgaggagaactcgtaggaaccgtacgacggtaaccgttagttaagtttagttaggtacgagttaagggttgaacgttaaggtacgttaactttaccgtttacgttaaccgttaaggtttcgggggttttaaacgggg

SEQ ID NO: 351028 - DNA, 786 bp, Homo sapiens
  misc_feature: GZ8MTXP01DJCOW.39.87.H10.1.454.CMB.2.raw
  modified_base (357)..(357): a, c, t, g, unknown or other
  misc_feature (357)..(357): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtagaagaagccgtgggcctcgagtgaaggtctctgcaggtcttctggaatccaccctcacccgacgtctatatcgcacgttggtcgacgacgacggcccccgtaggaacgaaggggtcttaggagtggagtgggatggatacgaacggtaancggtcggtactacgaaactaaagtttagtacgaacgaacgtaagggttaaacggtttacggaaggggtaccggtaaggggttacccaacccgtaagtaccggaaccggaacggggaacctaaccggtacccgtaattaacctaaacgtaaccgaacgtaccccttaaacgtaacgggttaaacggggggtaaacccgtttaaggggaaaccggtaccgggaaaccggggtaccgttaagggaaacgggtaaacccgtttccggtaaacccggggaaacccggaaaccgggtacccgggggttaacccgtttaaggtttaaacgtttaggttaggttacgggaaccggttaaaggttagttaaaggttcgtaaaggtttcccttacgtttaacttaccggttaagggtttaaccgggggtttaaaggggg

SEQ ID NO: 351029 - DNA, 623 bp, Homo sapiens
  misc_feature: GZ8MTXP01DM10H.39.87.H10.1.454.CMB.2.raw
  modified_base (297)..(297): a, c, t, g, unknown or other
  misc_feature (297)..(297): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagccgtgggcctgagtgaggtctctgcaggtcttcgtggaactccaccctcacccgacgtctatatgctacgtggttcgcgacncggcccctaggaacgaggggtcttggagtggagtgggatggataccgaaacggtacaggttcggtctacaaacgtaaatttgacgactaaacgtaaggtaacgtttcggaacggggcgtaagggtccaaaccgtagaccgaaccgaggggaacctacgtaccaatacgaaatacaacgtaccctaagtacgttaggaaacctggaagaccgaggtcgtaaggagtattaccgaggaccgtaacgtaacggttccgttagttaagtttagtggttaggcggaagtgtaagtgtaacgttcttacgtttaaccgttaagtttaagggg

SEQ ID NO: 351030 - DNA, 557 bp, Homo sapiens
  misc_feature: GZ8MTXP01ATNNM.39.87.H10.1.454.CMB.2.raw
  modified_base (249)..(249): a, c, t, g, unknown or other
  misc_feature (249)..(249): n is a, c, g, or t
  modified_base (364)..(364): a, c, t, g, unknown or other
  misc_feature (364)..(364): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcgagtgaggtctctgcaagcttcnggaatcaccctcaccgacgtctatatgcacgtggttgcgacacggcccctggacaagggctggagtggagtggagtggatacgaaaccggtaacaggtggtctacaaactaaatngacaacgagtaagtttcgagggcgagggtacaaccgtagtacgaaccgagggaacaccgtacagtacaatacagtccagagtaggaactggagcgaggctagagtatcgacgacgaacggcggcgtagttagttagtggcgttcggaggtaacgtgtaagtaacgttccgttcgtttcgttaacgtttaaggg

SEQ ID NO: 351031 - DNA, 653 bp, Homo sapiens
  misc_feature: GZ8MTXP01EQTQ8.39.87.H10.1.454.CMB.2.raw
  modified_base (396)..(396): a, c, t, g, unknown or other
  misc_feature (396)..(396): n is a, c, g, or t
  modified_base (554)..(554): a, c, t, g, unknown or other
  misc_feature (554)..(554): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgccccactccccaggtgcagctggtgcgaggtccgggactgaggtgaagagccgtggggcctgagtgaaggtctccgtgcaaggtcttcgtaggaactccacccctcacccgtacgtctatatcgctacgtggttgaccgacgacggccccgtaggacgaaggtcttaggaggtggagtgggataggatacgaaaccggtactaggtcggtctacgaaactaaagttncgtaacaacgtaagttaacggtttcggaggggtaccgtaggggtaccaaccgtaagtaccgggaaccggaacggggtaaccctaaccggtaccaacgtaacaaacgtaacgaaccgtaccctaaaggtaacgtacgggaacctaggaagacgtacggntaggatacgtcgtacgaaccggaacgtcggttacgtagtttagtagttgacggttggagtcgtagtcgtaacgtcttacgtttcgttaaggttaagggg

SEQ ID NO: 351032 - DNA, 582 bp, Homo sapiens
  misc_feature: GZ8MTXP01AJILK.39.87.H10.1.454.CMB.2.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
  modified_base (435)..(435): a, c, t, g, unknown or other
  misc_feature (435)..(435): n is a, c, g, or t
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcagtccggactgaggtgaagagctgggcctnagtgagtctctgcaggcttnggaatcaccctcaccgacgtctatatgcactggtncgacacggcccctggacaggtcttgagtggatgggatggatcgaacggtacaggtgtctacactaaaattagtgacaacgagttaacggttcgaagggtcgacgggtacaaccgtagtacggaccgaagggacaccgtaccaagtacaaattacgaacnccttacaaggtacgaacgtcgagacgaggtcnggaacgtntcgtaccgacgacgtaacggtccgttataacgtttgtcggtacgcggttagacgttaagtcgttaacgttaccttcgtttaccttaaccgttgggttttaacggggg

SEQ ID NO: 351033 - DNA, 502 bp, Homo sapiens
  misc_feature: GZ8MTXP01BYEIW.39.87.H10.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (430)..(430): a, c, t, g, unknown or other
  misc_feature (430)..(430): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctnagtgagtctctgcaggctnggaatcaccctcaccgacgtctatatgcactggttgcgacacggcccctggacaagggcttgagtgatggatggatcgaacggtacagtgtctnaacaattngcacagtagttcgagggcaggtcacagtgaccagggacacgtcatcaatacagcctagatggaactgacgcgtagctagacgtntacgtagacgaacgacggttcgtagttattagtgttcgcgagtgatgtagtacttacttcgttaagttaagg

SEQ ID NO: 351034 - DNA, 510 bp, Homo sapiens
  misc_feature: GZ8MTXP01BFJMM.39.87.H10.1.454.CMB.2.raw
  modified_base (356)..(356): a, c, t, g, unknown or other
  misc_feature (356)..(356): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggatgggatggatcgaacggtaccagtggtctcacaaaattntgcacagaagtttcagggcagggtcacatgacagggacacgtcatcaatacagacctacgatggaactgaagcaggctagagatcgtagacgcgaacggccttgtattagtggtgngagngaatggaactactcttactaattgttaacggggg

SEQ ID NO: 351035 - DNA, 583 bp, Homo sapiens
  misc_feature: GZ8MTXP01EE32K.39.87.H10.1.454.CMB.2.raw
  modified_base (249)..(249): a, c, t, g, unknown or other
  misc_feature (249)..(249): n is a, c, g, or t
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccggatggaggtgaaagagccgtggggcctcgagtgaagtctcctgcaggcttcnggaactcaccctcaccgacgtctatatgctacgtggtcgcgacgacggcccctagggacaagggtcttaggagtgggatgggatggatacgaaacggtaaccaggtaggtctacgaactaaaaattatggacaaacgtagtaaacgtttcggaaggggcgtacgggtcaaccgagtacggaccgaacggggaacctaaccggtaccctaaatacaaaactaaccgacgacccttaacgaaggtacgggaaacctggaacggcggacgcggtagaaaggctacgagcgacaagcgttgtattgtnaggngngagntgngtctnttntaagttgtg

SEQ ID NO: 351036 - DNA, 644 bp, Homo sapiens
  misc_feature: GZ8MTXP01CMZMH.39.87.H10.1.454.CMB.2.raw
  modified_base (250)..(250): a, c, t, g, unknown or other
  misc_feature (250)..(250): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagagccgtggggcctcgagtgaaggtctctgcaggcttcnggaactcaccctcacccgacgtctatatgctacgtggtgaccgacgacgggccccgtgggaacgaagggggtcttaggaggtgggagtggggataggactacgaaacggtaaccaggttcgtactacgaactaaaaattctgactaacgaagttaaggttcgaaggggcaacgggtcaacgagtacgaaccggaggaacctacgtacaatacaaatacgagtacctaagacggtaggaaacgtggaacggaccgaaggtctaggaacgtacgttaccgaggaacccggtaaccggaaccgggtaccgttagtttaattggttaacgggtggacggagttaggtaagtacggttaacgttctttacgttacgttaacggttaagggttaacgggg

SEQ ID NO: 351037 - DNA, 552 bp, Homo sapiens
  misc_feature: GZ8MTXP01A4UXS.39.87.H10.1.454.CMB.2.raw
  modified_base (250)..(250): a, c, t, g, unknown or other
  misc_feature (250)..(250): n is a, c, g, or t
  modified_base (361)..(361): a, c, t, g, unknown or other
  misc_feature (361)..(361): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagcctggggcctcagtgaaggtctcctgcaaggcttcnggaatcaccctcaccgacgtctatatgcacgtggttgcgacacggcccctggacaagggcttgagtggatgggatggatcgaacggtaacagtggtctacaaacaaattcngaccaagagtaagttcagggcaggtcacatcgacagggacacgtcagtacaatacagacctaacgagtaggaactgacgcgaggctaggaacgtagtcgtaggaccgaacgaaccggttccgttagttaagttagttggaggcgaaggtaagtagttgtacggttacttacgtttccttaaggtttaaggg

SEQ ID NO: 351038 - DNA, 524 bp, Homo sapiens
  misc_feature: GZ8MTXP01DXOMQ.39.87.H10.1.454.CMB.2.raw
  modified_base (254)..(254): a, c, t, g, unknown or other
  misc_feature (254)..(254): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (456)..(456): a, c, t, g, unknown or other
  misc_feature (456)..(456): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcaggtccgggactgaggtgaagaagcctggggcctcagtgaaggtctcctgacaaggcttcnggaatcaccctcaccgacgtctatatgcactggttcgcgacgtacggcccctggaccgaagggctttggagtggatgggatggatcgaacggtacagtgtctnaaacaaattngacacagtaagttcgagggcagggtcacagtgaccgagggacacgtcatacaaatacagcctaagataggaactgagcgagcgtagagntcgagacgaacgngcgtnttagtgtgttgcgagaagtagtaagtagtacttacttaacgttaagtaag

SEQ ID NO: 351039 - DNA, 603 bp, Homo sapiens
  misc_feature: GZ8MTXP01C672W.39.87.H10.1.454.CMB.2.raw
  modified_base (354)..(354): a, c, t, g, unknown or other
  misc_feature (354)..(354): n is a, c, g, or t
  modified_base (377)..(377): a, c, t, g, unknown or other
  misc_feature (377)..(377): n is a, c, g, or t
  modified_base (514)..(514): a, c, t, g, unknown or other
  misc_feature (514)..(514): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgacaaggtcttcgtggaatcaccctcaccgacgtctatattcacgtggttgcgacacggcccctggacgaagggcttggagtggagtggggatggatacgaaacggtaaccnggtgtctacgaactaaaaaattntgactaacgtaaaggtaaagtttccgaaggggtcaacggggtacaaccgaagtacggaaccgaagggaccaaccgttaccaatacgaaactacaacgacctaacaggttacggaactgaacgcgaagccgtagaagntcgagaaccgacgtaacgggtcttaggttaattagttcggtagcgagagtgtagtaagttactcgttacgtaacgttaagttaaggggg

SEQ ID NO: 351040 - DNA, 550 bp, Homo sapiens
  misc_feature: GZ8MTXP01DBBJP.39.87.H10.1.454.CMB.2.raw
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (343)..(343): a, c, t, g, unknown or other
  misc_feature (343)..(343): n is a, c, g, or t
  modified_base (519)..(519): a, c, t, g, unknown or other
  misc_feature (519)..(519): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtgggcctnagtgagtctcngcagctngatcaccnacgacgtctatatgctacgtggtncgacncggcccctggacaggtctgagtggatggatggatacgaacggtacagtgtctacaaataaattntagactaacgagtaacgttcgagggtcagggtcacagtcgacgaggaccacgtccatacaactacagtcctacgagttaggaacctgacggcgaggtcgtacggaagtccgtacgtacgaacccggaacgtaccggttccgttagtttagttagtcggttaggcgaggtaagtagngttaacgtcttcttaacgttaagtttaaggg

SEQ ID NO: 351041 - DNA, 589 bp, Homo sapiens
  misc_feature: GZ8MTXP01EEHMS.39.87.H10.1.454.CMB.2.raw
  modified_base (374)..(374): a, c, t, g, unknown or other
  misc_feature (374)..(374): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactgaggtgaagaagccgtggggcctcgagtgaaggtctcctgcaaggtcttcgtggaactcaccctcaccaacgtctatatgcacgtggtgcgacgacggcccctggaacgaaggtcttggagtggagtggatggatacgaaacggtacagtgtactacgaaactaaattnagacaacgtaagtaagtttcggaggggactacgggtacaacgagtacgaaccgaaggacctacgtaccaatacaaactaacgacgtacctaacggaagttaggaaaccttggacgacggacggtactaagggaatacgtagacggacgaacgacggttcgttagttagttagttgagttgagaagatcgtagtcttacgttcgttaagttaaggg

SEQ ID NO: 351042 - DNA, 544 bp, Homo sapiens
  misc_feature: GZ8MTXP01BBDKM.39.87.H10.1.454.CMB.2.raw
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (376)..(377): a, c, t, g, unknown or other
  misc_feature (376)..(377): n is a, c, g, or t
  modified_base (508)..(508): a, c, t, g, unknown or other
  misc_feature (508)..(508): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccgaggtgcagcgtggtgcgacggtccgggactggaggtagaagaacgccgtggggcctcgagtgaggtctcctgacgaaggtcttcgtggaactccaccctcaccgacgtctatatgcacgtggttcgcgacgacggcccctaggaacgaagggtcttggagtggagtggatgatacgaacgtangtgcncaaactatnnacagagtagttcgagggtcaggtcacagacgacgagggaccacgtacagtacaaatacacgtacctacgagtaggaactgacgcgagcgtagagtctcgacgacgaacgacgttcgtattgttagtgttgngagaagagtcgtaagtcttacttaagttcgtaaggg

SEQ ID NO: 351043 - DNA, 680 bp, Homo sapiens
  misc_feature: GZ8MTXP01DDNTJ.39.87.H10.1.454.CMB.2.raw
  modified_base (252)..(252): a, c, t, g, unknown or other
  misc_feature (252)..(252): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcatcgagtgaaggtctcctgcaaggcttcnggaactcaccctcaccgacgtctatatcgctacgtggttcgcgacacggcccccgtaggacgaagggccttggaggtggagtgggatggactaccgaaacggttaagaggttcggtctaacaaactaagttactacgacaacgtagtaaacgtttcggaggggtacctaggggttaccaacgagttacggaaccgaacgggggacctaacggtaccaacgtaactaaagttaacacggacctaaaccgtagtaacggaaccgttaggacggtaccgaggttaccgtaggaacgtacgtacgtaacggaacggtaacccgttacggggtaccgttagtttaaagttcggtttaaggggttcggttaacgggtaaggtaacgtaacggttacggtaacgtttaccgtttaaccgttaaccggtttaacgg

SEQ ID NO: 351044 - DNA, 697 bp, Homo sapiens
  misc_feature: GZ8MTXP01AYC4Z.39.87.H10.1.454.CMB.2.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatccctccctgtctgcatctggtaggagacagagtcaccatcacttggccggnaagtcgaggactaaattaaaatgtattagcgtaggtancagacaagaaaccgaggaaactccgtaagtcctagatctatgtatcgtacctacgtagggtttaggaacggtcggggttaccagtacgtaaggttccgacggtcggacgtaggtacggaattcgtgggactagtactttcactacctacaccactaccgacccacggtcccgtacggtacccggtaccgtaaggttaacgttacgttttacgaacctttaaactttactttaaccgtaacgggtttaacctaaaacttttaattttaaccgttactttaaccgtcccggttaccttaccggttcggtttaccgggggacgggtaacgggaaccggtaagggttagggaaacgtaagttaaaccgaaacggttacgttgggttcggttacctcggactaacccgtgttaccgttcgtcctttaacgttaaccccg

SEQ ID NO: 351045 - DNA, 609 bp, Homo sapiens
  misc_feature: GZ8MTXP01BYQSE.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccggactgaggtgaagaagcctggggcctcgagtgaaggtctcctgcaaggcttctaggaatccaccctcaccgacgtctatatgctacgtggttgcgacacggccccgtggaacgaagggtcttggagtggagtgggatggatacgaaaccggtacaggtgtctacgaaaactaaattgtgactaacgaagtaacgtttcgaaggggtcgaggggtaccaaccgtagtacgaaccgaagggaaccacgttaccaattacgaaactaacgacgtacctaacgtacgtaggaaactggaagcgagggctagagtatcgtacggaccgaacgtcgggttccgttgttaagttagtgttcggttggaagtaagtacgtaaggtagtacgtttacgttaaccgttaaggtttaaggg

SEQ ID NO: 351046 - DNA, 599 bp, Homo sapiens
  misc_feature: GZ8MTXP01DIEJT.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagagccgtggggcctcgagtgaaggtctcctgacaaggcttcgtggaactcaccctcaccgacgtctatatgctacgtggtgccgacgcggtcccctgggacaagggctggaggtggagtgggatggatacgaaaccggtagagtggtctacgaaactaaattcagcaacgagtaacgttgagggtcagggtacaccgtagtcgaccgaagggactaacgtcaactacaaacgtacgacgacccgtaacgaacgttggaaacctggaacgcgaggtctaggagtaactcgtacggaacgtaacgtaccgggttacgttgttaagttgtaggttggacgaaggtaagacgttgtaacggttcttcgtttaacgttaacgtttaagggg

SEQ ID NO: 351047 - DNA, 532 bp, Homo sapiens
  misc_feature: GZ8MTXP01AJUHW.39.87.H10.1.454.CMB.2.raw
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaggtctctgcagctngatcacctnaccgacgtctatancgcactggttgcgacgacggcccctggacgaagggtcttgagtggagtgggatggatcgaacggtangtgtctacaaactaaattngacacagtaagttcgagggcacggtacaccagtcgacgagggaccacgtcatcaatacagccagatggaactgancgaggctagagtntctacggacgaacgcggttacgtgttacgttagtggttgcgttagaagtagtaagacgttaccttcgtttaaccgttaagttaacggg

SEQ ID NO: 351048 - DNA, 566 bp, Homo sapiens
  misc_feature: GZ8MTXP01CFZ3W.39.87.H10.1.454.CMB.2.raw
  modified_base (377)..(377): a, c, t, g, unknown or other
  misc_feature (377)..(377): n is a, c, g, or t
  modified_base (527)..(527): a, c, t, g, unknown or other
  misc_feature (527)..(527): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctcttctggtggcagcagccacaggacgcccactcccaggtgcagctggtgcaggtccgggatgaggtagaagaagccgtgggcctgagtgaaggtctcctgcaaggtcttcgaggactccaccctcaccgacgtctaatatcgctacgtggttgccgtacgacggcccctggaaccgtaagggtcttggagtggagtgggatggatacgaacggtacagtgtactacaaataaattnagacaagtagtaagttcgagggactagggtcaacgagtacgaccgagggacctacgtcaatacaatacagtaccctaagacgtaggaaactgaacgcgaggtcagagtactacgacgaccgaacgacggttcttagttagtagttgcggngagtaagatcggtattcttcttaacgttaagtttaaggg

SEQ ID NO: 351049 - DNA, 670 bp, Homo sapiens
  misc_feature: GZ8MTXP01C2XGA.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtagaagaacgccgtggggcctcgaggtagaaggtcctccgtggacaaggtcttcgtaggactaccaccctcaaccgacgtctatatcgactacgtggtcgacgacgaccggccccgtaggaacgaacgggtcttaggagtggagttgggatggactacgaaacggtactacggttcggtactacaaactaaattaacgagaacaacgtaaaggtaaacgtttcggacggggtacgtacgggtaccaacgtagtacgaaccggtagggaacctaaccggtacctaagtaacaaacgtaccgaacgtaccctaacgaagttacggggaacctaggaacgacgaaggtacctaggacgtaacgtcgtaccggaaccgccgaacgggttcgtaagttagttagttgtaggagaagttgttagtaagtacgttcttacgttacgttacgtaacgggttgggtttaacggg

SEQ ID NO: 351050 - DNA, 688 bp, Homo sapiens
  misc_feature: GZ8MTXP01A5L3P.39.87.H10.1.454.CMB.2.raw
  modified_base (228)..(228): a, c, t, g, unknown or other
  misc_feature (228)..(228): n is a, c, g, or t
  modified_base (267)..(267): a, c, t, g, unknown or other
  misc_feature (267)..(267): n is a, c, g, or t
tcagtcgcactagtcacgaccggtgctcgatttagcagtactgcgttgggtttgggggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacgttggccggganaagtcgagggactaaattaaaatgtattagcgtaggtancagacaagaaaccagggaaacctctaaggtcctgatctatgatcgacctcgtaggtttaggaaggtcgggtaccagtacgtaaggttccgaggtcggactaggtcggtaaacttcggaaggggtactaggttactttaccgaccttctaccaccctactaccgaacccgtacgcccgttacgggacccggtaccgtaggttaaacgttacttttacgaccttaaactttacgtttaacctacggttaaacttaaactttaaattttaacttctttaacctcccgtacttacccgtacggtttacggggacggtaacggggtaaccgtaagggtacgggaaagtaacttaaaccggtaaaaccggtaagttggttcggttactccggacctaaccgtattcgttcgttccttaactaacccg

SEQ ID NO: 351051 - DNA, 721 bp, Homo sapiens
  misc_feature: GZ8MTXP01AUAQL.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggtgcgacacggcccctggacagggcttgagtggatgggatggatcgaacggtaaccaggtggtctacaactaaaaattatcggacaaccgtagtaaacgttttcgaacggggtactaacgggggttaccaacccgtaagtacggaaacccggaagggggtaacccaacccgggttacccaaacgttaacccgaaaacttaacccgaaacggtaccccttaaacgaacggttacggggaaacccgttggaacggtaccgtaacgggaccgttaggaaaccggtattaccggtacggaacccgggaaccgtaaccgggggtcccgtttagggtttaaactttaaggtttcgggttacgggttacggttaacggaaggtaacgttaggtaacggttttaaaccttccgtttaacgttaacccgtttaaggttttaaccgggggg

SEQ ID NO: 351052 - DNA, 579 bp, Homo sapiens
  misc_feature: GZ8MTXP01DU6E0.39.87.H10.1.454.CMB.2.raw
  modified_base (381)..(381): a, c, t, g, unknown or other
  misc_feature (381)..(381): n is a, c, g, or t
  modified_base (537)..(537): a, c, t, g, unknown or other
  misc_feature (537)..(537): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcgagtgaaggtctctgcaaggtcttcgtggaatccaccctcaccgtacgtctatatgcacgtggtgcgacgacggcccctggaacgaagggtcttggaggtggagtggatggatacgaaaccggtactagtcggtactacgaaaactaaattcngtacaacgtaagtaacggttcggaagggtacgagggtacaacgagtacgaccgaagggacctacgtacaatacaaactacagtacctaacggagtaggaactgagcgaggctagatcgtcgacggcgaacgacggttcgtagttattgtgttaggngttagaagatcggtaactacttcgttaacttaagttaagggg

SEQ ID NO: 351053 - DNA, 723 bp, Homo sapiens
  misc_feature: GZ8MTXP01AKOFG.39.87.H10.1.454.CMB.2.raw
  modified_base (226)..(226): a, c, t, g, unknown or other
  misc_feature (226)..(226): n is a, c, g, or t
  modified_base (339)..(339): a, c, t, g, unknown or other
  misc_feature (339)..(339): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctnagtgaagtctctgcagcttctggaatcaccctcaccgacgtctatatgcacgtggttgcgacgcggcccctggacaagggcttggagtggagtggatggatcgaaccggtacngtgtctacgaaactaaattgtacgacaacgtagtaacgtttcgaaggggtcgacggggttccaaccgtacgtacggaacccgaacggggtaacctaaccggttacccaacgttaaccaaaacgttaaccgaaccgtaccccttaaacggtaaacggtttaacggggaaaacccgttagggaaaccggtcggaacggggtaaccgttacgggaaagggtacctttaccggtaacggaaacccggtaacccggaccgggttaacccgggttacgtttaaaacgggtttacgtttcggggttaaggaccgggttaagggaacggtaacgttaaggggttaaccgtttaaaccgttccttttaacccgttaaacgttttaacgggggg

SEQ ID NO: 351054 - DNA, 617 bp, Homo sapiens
  misc_feature: GZ8MTXP01ALKG2.39.87.H10.1.454.CMB.2.raw
  modified_base (478)..(478): a, c, t, g, unknown or other
  misc_feature (478)..(478): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctctgcaggcttcaggaatccaccctcgaccgacgtctatatgctacgtggtgccgacgacggccccgtaggacgaagggtcttaggaggtggagtgggagtaggatacgtaaacggtaacaggtcggtactacaacgtaaattaagtacgctaacgtaaaggtaacggtttacggaggggtacgacggggtaccaacgtagtacggaacgtacggggaccacgtaccatacaatacagacctanagtacgggaacgtgacgcgaggctaggagtacgtcgtacgacgacgtcggtcgtagttagttagttggtacggaggttaggttagttagtaacggtagtaactttcgttacgttacgttgggttcggggtttaacgggg

SEQ ID NO: 351055 - DNA, 596 bp, Homo sapiens
  misc_feature: GZ8MTXP01AQ4ZI.39.87.H10.1.454.CMB.2.raw
  modified_base (511)..(511): a, c, t, g, unknown or other
  misc_feature (511)..(511): n is a, c, g, or t
  modified_base (562)..(562): a, c, t, g, unknown or other
  misc_feature (562)..(562): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaacgccgtggggcctcgaggtgaaggtcctcctgacgaaggtcttcgtggaactccgaccctcaccgacgtctatatcgctacgtggttcgccgtacgaccggtccccgtagggaccgaagggtcttggaggttggagtgggtaatggacgtacgaaacccggtagagtcggtctacaaactaaatttcagtacaacgtagtaagtttcgagggtacgacgggtaccaacgagtaggaacccgagggaccacgtaccataccgaataaccgagacctacgaagttacggaactgagcgnggagagactgtacgtacgacgcgtcgttgtagttagtagtgagagagtaanagtaatacgtacttacgttaacgttaaggtaagg

SEQ ID NO: 351056 - DNA, 621 bp, Homo sapiens
  misc_feature: GZ8MTXP01C9JDH.39.87.H10.1.454.CMB.2.raw
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatccctcctgtctgcatctgtaggagacagatcaccatcacgttgccggacaagtcagggactaaattaaaatgtattagcctggtatcagacaagaaaaccagggaaaactccgtaaggtcctagatctatgatcgcctcgtaaggtttaggaaacgtcggggtacccagtacgtaacggttccagggcggcgaggtggaagttcgtgggactagtactttcactctacacactcaccacgcctgaccgtactaggtaattactttcgaactaactttattactaggttaaactaaactttaaatttaacttcttaacctccgtcttacgtacggtttcgggacgggtaacgggtaaccggtaaagggtacggaagtaacgttaaccgaaaacggtacgttggcggttacttcgactaacgtacttcgttacgttccttcgttaaccc

SEQ ID NO: 351057 - DNA, 560 bp, Homo sapiens
  misc_feature: GZ8MTXP01BRTG3.39.87.H10.1.454.CMB.2.raw
  modified_base (372)..(372): a, c, t, g, unknown or other
  misc_feature (372)..(372): n is a, c, g, or t
  modified_base (455)..(455): a, c, t, g, unknown or other
  misc_feature (455)..(455): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
  modified_base (518)..(518): a, c, t, g, unknown or other
  misc_feature (518)..(518): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaggcttctaggatccaccctcaccgacgtctatatgcacgtggtcgcgacgacggccccgtaggacgaagggcttaggagtcggagtgggatggatacgaacggtaacacggtggtctacaactaaatttaancgtcaacgtaaggtaacgtttcgagggtacgagggtacaccgagtacggaccgagggacacgtacgatacaatacacgactanagtagggactgancgagcngagactcgngaccgacgcggcgtagttattagttggagcgaggngagtgagttaacttcttacgttagtaagttcgggtttaaggg

SEQ ID NO: 351058 - DNA, 590 bp, Homo sapiens
  misc_feature: GZ8MTXP01CFZNV.39.87.H10.1.454.CMB.2.raw
  modified_base (276)..(276): a, c, t, g, unknown or other
  misc_feature (276)..(276): n is a, c, g, or t
  modified_base (370)..(370): a, c, t, g, unknown or other
  misc_feature (370)..(370): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctcttcttggtggcagcagccacaggacgcccactcccaggtgcagctggtgcgagtccgggatgaggtgaagaagcgtgggctcgagtgaaggtctcctgcaaggcttctggaatcaccctcaccgacgtctatangcacgtggttgccgtacgacggcccctggaccaagggcttggaggtggatggatggatacgaaaccggtacaggttgtctagaaaactaaattntgacaacagtaagttcgaggcagggtcacgagtcgacgagggacacgtacagtacaaatacagtaccaacgtagtacggtactaggaacgcgaggcctaggacgtactacgtacgaaacgtaaccgtaacgggttcccgttagttaagttagttggttggaccgttaaggtaagaacgtttggtaacttacgttacctttaacgttaaccgtttaagggg

SEQ ID NO: 351059 - DNA, 594 bp, Homo sapiens
  misc_feature: GZ8MTXP01C8N12.39.87.H10.1.454.CMB.2.raw
  modified_base (383)..(383): a, c, t, g, unknown or other
  misc_feature (383)..(383): n is a, c, g, or t
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggagggtgaagaagccgtggggcctcgagtgaaggtctccgtgcaagggtcttcgtggaactccaccctcaccgacgtctatatgcacgtggtgcgacacggcccctggaccgaagggtcttggaggtggagtgggattggatacgaaacggtaacaggtcggtctacgaactaaaaattntggactaacgaaggttaaagttcggaggggacgaggggtacctaacgatacggacgagggaccaacgtccaatacaagtacacgtacctaacgtaggtacggaaacgttaggaacggacaaggccgtagaaggactacgagaccgcgaacggtcgttagtattgttgngacgngagntagtcgttactcttacttaagttggttaacgggg

SEQ ID NO: 351060 - DNA, 642 bp, Homo sapiens
  misc_feature: GZ8MTXP01AYSYV.39.87.H10.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (366)..(366): a, c, t, g, unknown or other
  misc_feature (366)..(366): n is a, c, g, or t
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcgagtccgggactggaggtagaagagccgtgggcctnagtgagtctctgcaagcttgnggactcaccctcaccgacgtctatatgctactggtgcgacgacggccccgtggacgaggcttggaggtggagtgggataggatacgaacggtacgaggtcggtactacaactaaaattancgacaacgaggtaagtttcggagggtcgacggtacaccgtagtacgaccgaggacgtaccgtacaataccaaagtacacgacctaacgagtacggtaacgtagacgaccgaggacgttaggaacgattaccgtaacggaacccgaaccggtaaccgggtcccggtttaggttaaactttaggttacgggttaacggacggttaagggttaacggtaagttacggttaacggttacctttaccgtttacgttaaccggtttaagggtttaacggggg

SEQ ID NO: 351061 - DNA, 678 bp, Homo sapiens
  misc_feature: GZ8MTXP01B1TF2.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggatgaggtgaagagccgtggggcctgagtgaaggtctcctgcaaggtcttcgtggaactccaccctcaccgacgtctatatcgctacgtggttgcgacgacggccccgtaggacgaagggtcttaggagtggagtgggatggactacgaaaccggtacaggtggtactacgaaaactaaagtttctagactaacgaaggttaaacgtttcggaaggggtacgtacggggtaccaaccgtagtacggaacccgaaggggaaccctaccggtaccaacttaccaaactaaccgaacgtacccttaacggaacgttaacgggaaaccgtaggaacgccgaacgggtacgttacggaagtacgttaccgtacggaaccggaaccgtacccgggttacggttaggttaaatttaggttggttacggaggaaggtaagtagttaaggtacgttacctttacgtttaacgttaacgtttaaggg

SEQ ID NO: 351062 - DNA, 706 bp, Homo sapiens
  misc_feature: GZ8MTXP01CRWZQ.39.87.H10.1.454.CMB.2.raw
  modified_base (248)..(248): a, c, t, g, unknown or other
  misc_feature (248)..(248): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagagccgtggggcctcagtgaggtctctgcaggcttcnggactcacccctcaccgactctatatcgctacgtggttcgccgtacgacgggtccccctaggggaacgaagggggtcctttagggaggtagggagtgggggaagtacggtaacgtacgtaaacggtaaccgtagggttcgtactaaccaaattaaaacttgtccgaacgtaaacgtaaacgggtttacgttaccgggaacgggtacgtacggtacccaacgtaggtaccggaacggacgggaacctaccgtactaactaacgaaacgtacgaaccgtacccgttaagacgggttaacggaacgtacgaacggtaccggagggtactaggtaacgtcgttacgacggtaacccgacgggaaccccgggttgttaggtttattacggttggagacggttaggacgttaagtacgtaacggttaccctttattaccgttaagttaaggggtttaacggggg

SEQ ID NO: 351063 - DNA, 671 bp, Homo sapiens
  misc_feature: GZ8MTXP01EG75F.39.87.H10.1.454.CMB.2.raw
  modified_base (505)..(505): a, c, t, g, unknown or other
  misc_feature (505)..(505): n is a, c, g, or t
  modified_base (620)..(620): a, c, t, g, unknown or other
  misc_feature (620)..(620): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcgaggtccgggactggaggtgaagacgccgtgggcctcgagtgagtctcgtgacaaggtcttcgaggaactcaccctcaccgacgtactactatcgctacgtggttcgcgaaccgacgggtccccctagggacgtaaagggtctttaggaggttggaagtgggggataggtactacgtaaacggtaaccaggttggtacctaccgaaactaaaaaatttgaacggactaaagtaaaggtaacgtttaccggaggggtacgtaacgggtacaaccgagtacggaaccgtaagggactaaccgtacacgtactaaanacgaacgtaccctaagtaacggtacgggtaaacctggaacgacggaacggtccgttaggaaggtacttacgtacgaaccgacggtaacggtccgttaggttattaagtggtacgngagagtaacgtaggtaacgttactacttacgtaacgttaaggtttaacggg

SEQ ID NO: 351064 - DNA, 623 bp, Homo sapiens
  misc_feature: GZ8MTXP01DFFFW.39.87.H10.1.454.CMB.2.raw
  modified_base (359)..(359): a, c, t, g, unknown or other
  misc_feature (359)..(359): n is a, c, g, or t
  modified_base (377)..(378): a, c, t, g, unknown or other
  misc_feature (377)..(378): n is a, c, g, or t
  modified_base (584)..(584): a, c, t, g, unknown or other
  misc_feature (584)..(584): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagccccactcccaggtgcagctggtgcaggtccgggactgaggtagaagagccgtggggcctcagtgaaggtctcctgcgaaggtcttcgtggaactccaccctcaccgtacgtctatatgctacgtggttcgcgacacggccccgtaggacgaagggtcttggagtggagtgggatggatcgaaaccggtanagtgtcacaaactaattnncaactaggtaagttcgacgggcacggtacacgagtgaccgaggacacgtacactacaaactacgaacgtacctaacgtaacgtacgggtaaaccgttaggacggacgacggtaccgtaggaacgtacgtacgtacggaacggtaaccgtacgggttccgttagttaagtttagttaggttaggttcggaagaacggttttttaagnggtaacgttaccttacgtttaacgttaacgtttaagggg

SEQ ID NO: 351065 - DNA, 610 bp, Homo sapiens
  misc_feature: GZ8MTXP01C998V.39.87.H10.1.454.CMB.2.raw
  modified_base (367)..(367): a, c, t, g, unknown or other
  misc_feature (367)..(367): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagaagcgtgggcctgagtgaggtctctgcaggcttcgtgaatcaccctcaccgacgtctatatgctacgtggtgacgacacggcccctaggaccgaagggtcttggagtggagtggatggatacgaaaccggtacagtggtacactaaactaaatttnacgactaacgaagtaaacggtttcgaagggggtacgtacgggtacaacccgaagtacggaacccgaacggggaaacctacccgggttaccaaacgtacaaaactacgaacgacccttaagacgttaacggaactggagcgaggcctagacgtatcgacgacgaaccgcgggttaccgtagttagttaagttgcggagagtaacgtagtaagtacgttacttcgttaacgttaacgtttaaggg

SEQ ID NO: 351066 - DNA, 623 bp, Homo sapiens
  misc_feature: GZ8MTXP01BPAFU.39.87.H10.1.454.CMB.2.raw
  modified_base (250)..(250): a, c, t, g, unknown or other
  misc_feature (250)..(250): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcgagtgaaggtctcctgcaaggcttcnggaactccaccctcaccgacgtctatatgcacgtggttgcgacacggcccctggacaagggcttggagtggagtgggatggatcgaaacggtaaccaggtggtactacgaactaaaaaattagtgaccaacgtaaggtaacgtttcgaaggggctacggggtacaaccgtagtacggaaccgacggggacaccggtaccaatacaaacttaccacgtaccttaacgaggtacggaaactgagacgaggcgtaggaacgtactccgtaggaccggaaccgtaacggggtcccgtttaggttatttagttggtacggacgaggaggtaagtacggtaacttacgtccgtttacgtaaccgttaagggtttcgggg

SEQ ID NO: 351067 - DNA, 572 bp, Homo sapiens
  misc_feature: GZ8MTXP01BDK6V.39.87.H10.1.454.CMB.2.raw
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (338)..(338): a, c, t, g, unknown or other
  misc_feature (338)..(338): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtgggctcagtgagtctcngcagcttcnggaactcaccctcaccgacgtctatatcgcacgtggttgcgacacggcccctggacgaagggcttggaggtggagtgggatggatacgaacggtacnggtgtctacaataaaattatgacacgtaagtacgtttcgagggacgtacgggtcaccgtagtacggaccgaagggactaccgtaccaatacaaacgtacacgtacctacgagtacggaactgagtacgaggcgtagacgtgtactacgaccggacgtaacgggtcgttaggtatttaagtgcggagttagagtaagtgtaacgttacttcttacgttaacgttgtttaacgggg

SEQ ID NO: 351068 - DNA, 646 bp, Homo sapiens
  misc_feature: GZ8MTXP01CYMS6.39.87.H10.1.454.CMB.2.raw
tcagtcgcactagtcacgaccggtgctcgatttagcagtactgcgttgggtttgggggagcatcacccagcaaccacatctgtcctctagagatcccctgagagctccgttcctcaccatggactggacctggaggatcctcttcttggtggcagcagccacaggagcccactcccaggtgcagctggtgcaggtccgggactgaggtgaagaagccgtggggcctcgagtgaaggtctccgtgacgaaggtcttcgtaggaactccaccctcgaccgacgtctatatcgctacgttggtcgcgacgacggcccctggacgaagggtcttggaggtggagtgggatggatacgaaaccggtacgaggtcggtactacgaaaactaaattgtagacaacgtaaggtaacgtttcggagggtacgacggggtacaaccgtagtacggaaccgaacggggaacctaaccggtacctaactaccaaactacgacgtaccctaagacgtaggaactggacgcgaggcaggacgtacttacgacgaacggaacgtcggttcggtttaagttagtttagttagggttacggcggttaaagtaagtaagttcgtaacggttacctttacgtttaacgttaacgttttaaggggg

SEQ ID NO: 351069 - DNA, 521 bp, Homo sapiens
  misc_feature: GZ8MTXP01A84TP.39.87.H10.1.454.CMB.2.raw
  modified_base (246)..(246): a, c, t, g, unknown or other
  misc_feature (246)..(246): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (400)..(400): a, c, t, g, unknown or other
  misc_feature (400)..(400): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaggtctctgcaggctcngaatcacctcaccgacgtctatatgcactggttgcgacacggcccctggacaagggcttgagtggatgggatggatcgaaccggtaacnggtggtctacgaaactaaattntgcacagtagtttcgagggcagggtcaccagtcgacagggacncgtacatacaatacagcctacgatggactgagcaggctagacgtatctacggacgtaacgacggttccgtagttagttagtgttgcgagaagatgacgtacttcttcgttaagttaacggg

SEQ ID NO: 351070 - DNA, 787 bp, Homo sapiens
  misc_feature: GZ8MTXP01AS8MG.39.87.H10.1.454.CMB.2.raw
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcacatcacttgccggnaagtcaggcaattaaaatgattagcctggtancagcagaacaaggaaactcgtaagtctgatctatgatcgccctcgaagttttacgggaaaggttcgggggtaccccaagtacgtaaacgggttcccgacgggtcgggacctagggtacgggtaaaacgttccggtaacgggggtaaacctaagggttaactttttacccgaacgtttcccgtaccaaaccccgtaacttacccaaccccgtaacggcccccgttgggacccggggtaccccttaagggtaaaaccggtttagttttttaacgaacccgtttaaaacccgttttaattttaacccggtacggtttaaacccttaaaaaactttaaagttttttaaaaccttttcccgtttaaaccttccccggttaccctttacccggtaaaccggttttttccgggggaaccggggttaacggggaaaccctaaagggggttacgggaaagtaacgttaaccgaaaaaccggtaacgttggttacgggccttaacggacctaaccgtaacttccttggttcctttaacctaaccg

SEQ ID NO: 351071 - DNA, 565 bp, Homo sapiens
  misc_feature: GZ8MTXP01AWD8Z.39.87.H10.1.454.CMB.2.raw
  modified_base (227)..(227): a, c, t, g, unknown or other
  misc_feature (227)..(227): n is a, c, g, or t
  modified_base (263)..(263): a, c, t, g, unknown or other
  misc_feature (263)..(263): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
  modified_base (474)..(474): a, c, t, g, unknown or other
  misc_feature (474)..(474): n is a, c, g, or t
  modified_base (508)..(508): a, c, t, g, unknown or other
  misc_feature (508)..(508): n is a, c, g, or t
  modified_base (528)..(528): a, c, t, g, unknown or other
  misc_feature (528)..(528): n is a, c, g, or t
tcagtcgcactagtcacgaccggtgctcgatttagcagtactgcgttgggtttgggggggagtcagacccactcaggacacagcatggacatgagggtccccgctcagctcctggggcttctgctgctctggctcccaggtgccagatgtgccatccagttgacccagtcctccatccctccctgtctgcatctgtaggagacagagtcaccatcacttgccggganaagtcaagggctaattaaaatgtatttagctggtancagcaagaaacagggaaactccgtaaggtcctagtatctatgatcgcctactaggtttagggaaagtcggggtcccagtaccgaaggttccaggcggcgtaggaggtaatcgtgggactagtatttaccactctacaccatcaacctncgtagcgacttagaacttntttcattaacttagtactgtaactaacttaagtttacttctacncctactcgtagttcgggacggtacgacgtaaggngagtacacgtaaacgtacgnggttcgctgaccaacttctcgttcttaacttcgtaac

SEQ ID NO: 351072 - DNA, 649 bp, Homo sapiens
  misc_feature: GZ8MTXP01CKXOS.39.87.H10.1.454.CMB.2.raw
  modified_base (142)..(142): a, c, t, g, unknown or other
  misc_feature (142)..(142): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctnttctggtggcagcagccacaggagcccactcccaggtgcagctggtgcaggtccgggactgaggtgaagaagccgtggggcctcagtgaaggtctcctgcaaggtcttcgtggaatccgacccctcacccgacgtctatatcgcacgtggttgacgacgacggcccctgggaacgaagggtcgttaggacgtggagtgggaatggatacgaaaccggtacaggtggtactaccgaaactaaaagtttgagacctaaacgtaaggtaacgtttacggacggggacgtaacggggtccaaccgtagtacggaacccgaaggggaaccacggtaccatacaaactacacgacctaacggacgttaggggaacctaggaacgcgtacggcgttacgagtagttccgagacccgaaccggtaacggttcccggttagttagtttaacgtggttacgacggttaggaaagtataacggtacgttacttacgtttaaccgttaagtttaagggg

SEQ ID NO: 351073 - DNA, 648 bp, Homo sapiens
  misc_feature: GZ8MTXP01EXWM9.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagaagccgtggggcctcagtgaaggtctctgcaagcttctgactccaccctcaccgctctatatgcacgtggtgcgacgcggcccctaggacgaagggtcttaggaggtggatggggagtaggatacgaaacggtacaggtcggtactacaataaacttaatcggaaccaaacgtagggtaaacggtttcgaacgggggtacgacgggttacacccgtagtacggaaccgaagggaccacggtaccaagtactaaacgtacacgacctaacgaagtacggggaaactggaacgacgtaggaccgtagaaggtactcggtacgaaccggaaccgcgggtaaccgttgttagttaagttcggaggtaacgttagagggttattcggtaacgttccgttaacgtttaccgttacgttaagggtttccgggggtttaaagggg

SEQ ID NO: 351074 - DNA, 761 bp, Homo sapiens
  misc_feature: GZ8MTXP01CZROA.39.87.H10.1.454.CMB.2.raw
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
tcagtcgcactagtcacgaccggtgctcgatttagcagtactgcgttgggtttgggggggagtcagacccactcaggacacagcatggacatgagggtccccgctcagctcctggggcttctgctgctctggctccaggtgccagatgtgccatccagttgacccagtctccatccctcctgtctgcatctgtaggagacagntcacatcactgcggcaagtcaggactaattaaaaatgtattagctaggtanacagacaagaaaacgaacgggaaaactaccgtaaaggtcctagactacgtatgactcggacctacgtaaggtttagggaaacggtcgggggtacccaagtacgtaacggttacccgaggtacggacgtaaggtaggaaacgttacgtaaggggaacctaagggttaacttttaccgaaaccgttacctaccaaaccctacgtacccaacccgtaacgggccccttaggacccgggtaacctttagggaaaaccggtttagtttttaacgaaccttaaaacgttttaaagtttaaccgttaagttaaccgttaaaaaaccttttaaagttttaaacgtttactttaaaccttcccgtacctttaccggtaacggttttacccgggggaggttaaaccgggggaaaccggtaaaggggttaaggaaggttaaacacccggaaaaaagtcttagggttcggttactaacggaccttaaccctatttccgttacgttccttaacgttcccg

SEQ ID NO: 351075 - DNA, 603 bp, Homo sapiens
  misc_feature: GZ8MTXP01B5Z88.39.87.H10.1.454.CMB.2.raw
  modified_base (143)..(143): a, c, t, g, unknown or other
  misc_feature (143)..(143): n is a, c, g, or t
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctnttcttggtggcagcagccacaggagcccactcccaggtgcagctggtgcaggtccgggactgaggtagaagaagccgtggggcctcgagtgaaggtctcctgcaaggtcttcgtggaactcaccctcaccgacgtctatatgcacgtggttgccgtacgacggccccgtaggacgaaggggcttggaggtggagtgggatggatacgaacgtaacnggtgtactcaaacaaattngacactaggtaacgtttcgagggcgagggtaccacgatagacgaggacacgtcactacaactacacgactacgatacggaactagacgtcgacggacgtacggaagtactacgtacggaacgaacgtaccgggttaccggttgttaaagtttcggttagttacggacggttaaggtaagaggttgtaaacggttcttacgtttaaccgttaacgttttaaggggg

SEQ ID NO: 351076 - DNA, 560 bp, Homo sapiens
  misc_feature: GZ8MTXP01DTS94.39.87.H10.1.454.CMB.2.raw
  modified_base (242)..(242): a, c, t, g, unknown or other
  misc_feature (242)..(242): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (434)..(434): a, c, t, g, unknown or other
  misc_feature (434)..(434): n is a, c, g, or t
  modified_base (474)..(474): a, c, t, g, unknown or other
  misc_feature (474)..(474): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcgaggtccggatgaggtgaagagcgtgggctgagtgagtctcctgcagcttngactccacctcaccgacgtctatatcgctacgtggtcgaccgaccgacggcccctaggacgaggtcttggaggtggagtgggatggaactacgaacggtaacgnggtacgtctacaacgtaaaattangacagtaagtacgttcgagggacgtacggtacacgtagtacgaacgacgacacgtacatacaanacagacctacgaggtagtaactgagacgagcgtagacgtntcgtacgacgacgaacggtcgttagttacgttagtagtgacgagagtaagtagtaacgttactagttagttcgttaaggttcgggg

SEQ ID NO: 351077 - DNA, 584 bp, Homo sapiens
  misc_feature: GZ8MTXP01A0PIJ.39.87.H10.1.454.CMB.2.raw
  modified_base (374)..(374): a, c, t, g, unknown or other
  misc_feature (374)..(374): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttctggaactccaccctcaccgacgtctatatgcacgtggttgcgacacggccccgtaggacgaagggtcttgagtggagtgggatggatcgaaaccggtacagtggtctacgaaactaaatttngacacgtaagtaacgtttcgagggcgtacgggtccaacgagtcggaaccgagggacacgtaccagtacaatacacgacctaagagtacggactggaacgcgtaaggctaggagtactacgtcggaaccgaacgacgggttccgtaggttaactttagtgttacgcgaagaacgtactaactttccctacttactaagttaacgttaacgg

SEQ ID NO: 351078 - DNA, 613 bp, Homo sapiens
  misc_feature: GZ8MTXP01AVX4J.39.87.H10.1.454.CMB.2.raw
  modified_base (248)..(248): a, c, t, g, unknown or other
  misc_feature (248)..(248): n is a, c, g, or t
  modified_base (343)..(343): a, c, t, g, unknown or other
  misc_feature (343)..(343): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaagtctctgcaaggcttcnggaactccaccctcaccgacgtctatatgcagtggtcgcgacgcggcccctggacaaggtctggagtggagtgggatggactacgaagtacccgngtgactacgaactaaaatttgcgactaaacgtaaggtacgtttacggacgggtcgtacgggtacccacgtaagacggaccgaacgggactaccgacctatacaagtacacgtacctaacgaggtacgaaacgtcgacggcgaacggccgttagggactacgttcgaaccggaccgaaccggtaacggtaccggttagttaaacgttgttggagttacggagttaggaatagtaacgttctccgtttacgtaagtttaagggtttaagggg

SEQ ID NO: 351079 - DNA, 534 bp, Homo sapiens
  misc_feature: GZ8MTXP01B51P0.39.87.H10.1.454.CMB.2.raw
  modified_base (354)..(354): a, c, t, g, unknown or other
  misc_feature (354)..(354): n is a, c, g, or t
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
  modified_base (491)..(491): a, c, t, g, unknown or other
  misc_feature (491)..(491): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaaacggtaacagtggtctcacaaattaangcaacagtaagttcgagggacagggtacacanagacgacggacgacgacactacaanacacgactacagtaggggaacgtagagacgacgacgagagagtactacgacgacgacggtaacgtcgttattattagtgngagagagtaagtagtaactcttcttacttaacgttggtaaggg

SEQ ID NO: 351080 - DNA, 683 bp, Homo sapiens
  misc_feature: GZ8MTXP01AMK8W.39.87.H10.1.454.CMB.2.raw
  modified_base (300)..(300): a, c, t, g, unknown or other
  misc_feature (300)..(300): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcgagtgaaggtctccgtgcaaggtcttcgtggaactccaccctcaccgacgtactatatgcacgtggtgcgacncggcccctggacgaggtctaggagtggagtgggatggatacgaacggtaccaggtgtctacaactaaaattgtcgacaaacgtagggtaacgtttacggaggggacgtaacggggtacccaacgtacggtaccggaaacccgggtaacgggtaaccgtaacccgggtaccctaaagttaacccgaaacgttacccgaaacgtaccccgtaacgtaacgggtacggtaaaccggtagaacggtaccgaggggtacctagggaacgtgtccgtacggaccgaccggtaacgggtccgttagtacgtttagtacgggtgttaccgggaggttagtgttacggtaactttaaccgtctttacggttaaccgttgggtttaacggggg

SEQ ID NO: 351081 - DNA, 726 bp, Homo sapiens
  misc_feature: GZ8MTXP01BYREF.39.87.H10.1.454.CMB.2.raw
  modified_base (268)..(268): a, c, t, g, unknown or other
  misc_feature (268)..(268): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacgttggccgggacaagtcgagggactaaatttaaaatgtatttacgcctaggtancagacaagaaaccagggtaaactccgtaagtcctagatctatgatcgcctcgtaggtttaggaacggtcgggtaccagtacgtaaggttccaggcggcgtaggtggaacttcgtaaggggactagttactttccgacttacctacaacctactacccaccgtacgtcccgttacggcccggtaccgtaggttaaacgttacttttcggaaccttaaacgttttacttaaccgttacggttaaacccttaaacgttttaaactttttaacctttaccgtttaacccgttccccggttacgtttacccgtttaaccgggtttccgggggaaccggggttaaaccggggaacccggtaaagggggtcggttaaacggtaaacgttaaccggtaaaacgtacgttcgggttcggccgttaacgacctaaccgttcttccgttacgtttcccttcttaacccg

SEQ ID NO: 351082 - DNA, 576 bp, Homo sapiens
  misc_feature: GZ8MTXP01A4NP4.39.87.H10.1.454.CMB.2.raw
  modified_base (256)..(256): a, c, t, g, unknown or other
  misc_feature (256)..(256): n is a, c, g, or t
  modified_base (351)..(351): a, c, t, g, unknown or other
  misc_feature (351)..(351): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgtattagcctggtancagacaacgaaaccagggaaaacctcgtaaggtcctgatctatgatcgcctcgtagtttggaaagtcgggtacccagtcgaaggttccaggcggnaggtggaatcgtgggactagtactttcactctaccactactcccaccgtacgccgtcggccggtacgtacgaagtttattttacgacttaaactttattactaggtaactaaacttaatttaacttcttactccgcttctacgttcgggacggacgggacgaaggtgaagtacttaacgaaacgtacgttggttcgcgtgacctaacatcgttgttccttcgtcc

SEQ ID NO: 351083 - DNA, 625 bp, Homo sapiens
  misc_feature: GZ8MTXP01DH8YL.39.87.H10.1.454.CMB.2.raw
  modified_base (527)..(527): a, c, t, g, unknown or other
  misc_feature (527)..(527): n is a, c, g, or t
  modified_base (581)..(581): a, c, t, g, unknown or other
  misc_feature (581)..(581): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagccgtggggcctcgagtagaaggtctcctgacaaggtcttcgtaggaactccaccctcacccgacgtctatatcgactacgttggtcgcgacgacggccccgtaggaccgaaggggtcttaggacggtggagtgggggatgggaacttacgaaacgggtaacgtggttcgggtacttacgaaactaaagtttaagtacggcaacgtaaaggttaaacgtttcgaacggggtacgacggggttacaccgtaagtacgaaccgaacgggacctacgtactaatacaatacacgacctaacagtaaggggaactggaacncgaggtcagagatcgagacgcgaagggtctagttattagttgtgcgggttaagngttagaagtactcttacgttacgttagttcggttgggttaacgg

SEQ ID NO: 351084 - DNA, 648 bp, Homo sapiens
  misc_feature: GZ8MTXP01A7S4P.39.87.H10.1.454.CMB.2.raw
  modified_base (254)..(254): a, c, t, g, unknown or other
  misc_feature (254)..(254): n is a, c, g, or t
  modified_base (395)..(395): a, c, t, g, unknown or other
  misc_feature (395)..(395): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtagaaggaagccgtggggcctcgagtgaaggtctctgcaggcttcgngaactccaccctcaccgacgtctatatgctacgtggtcgccgacgacgggcccccgtagggaacgaaggggtcttaggaggtgggagtgggggatgggaatacgaacggtaaccaggtcggtactacaaacgtaaaaattntcgacaacgtaaggtaacgtttcggaggggacgtacgggtaccaacgtagtacggaaccggacgggaacctaaccgtaccaacgtaacaaacgttaccgaacgtaccctaacgacggtaacgggtaacgtggaacggcgaacggtcgtaggaagtactccgaacggtaccgacggtaaccggtcgttagtattagtcgtggacgttgagtaagtagtaacttacgtacttacgtaacgttaaggttaacgggg

SEQ ID NO: 351085 - DNA, 578 bp, Homo sapiens
  misc_feature: GZ8MTXP01B27OU.39.87.H10.1.454.CMB.2.raw
  modified_base (259)..(259): a, c, t, g, unknown or other
  misc_feature (259)..(259): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (544)..(544): a, c, t, g, unknown or other
  misc_feature (544)..(544): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtagaagaagccgtggggcctcgagtgaaggtctccgtgacaaggtcttcgnggaactccacccctcaccgacgtctatatgctacgtggtgcgaccgacggccccgtaggacgaagggtcttggagtggagtggatggatacgaacggtacngtgtcagaactaatntgacacgagtagttcgaggcagggtcacgatcgaaccgaggaccagtaccagtacaatacagtacccaagtagtacggaactgaacgcgtaacgggcttaaggacgtacttacgacgggacccgaacggtcgggttaccggttattagttaagtgcggttagaggtaanagtaagtattacgttcttaacgttaagttaaggg

SEQ ID NO: 351086 - DNA, 686 bp, Homo sapiens
  misc_feature: GZ8MTXP01AB4XS.39.87.H10.1.454.CMB.2.raw
  modified_base (200)..(200): a, c, t, g, unknown or other
  misc_feature (200)..(200): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctcctgtctgcatctgtagganacagagtcaccatcacttgccgggcaagtcagggactaattaaaatgtattagcctaggtatcagacaagaaaccgaagggaaaactccgtaaaggtcctagactctatgatcgcccttacgtaggtttacggaaaggtcggggtaccaagtcccgtaaggttcaggccggagtaagggtggaagttcgtaggggactaggtactttacacttcctaccaacctactccgaaccctaggtccctacgggccggtaccttaggtaaacgttagttttacaccgtttaaacttaggtttaacgtacttaactaaacttaattttaacgttacctttacgtacccgtcttaccgttaccggtttccggggacgggtaaacgggtaaccgttaaaggggttcggaaataacggtaaaccttaaacgggttaacttcgggttaacggtccgtaacggtccctaaccttacggtttcccgttaacgtttccc

SEQ ID NO: 351087 - DNA, 648 bp, Homo sapiens
  misc_feature: GZ8MTXP01DRY2Q.39.87.H10.1.454.CMB.2.raw
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccgggcaagtcagggacaattaaaatgattagctgtatcagacaagaaaccaggaaactcgtaaaggtcctagatctatgatcgccttacgtaggtttaggaaacgttcggggtcccaagtaccgaaggttcaggccggataacggtggaatcgtagggactagtactttacacttcctaccaacctactacaaccgacgcccgttaggaccgtaccgtaggaaacgttacgtttacaccttaaactttactttaacgtagttaacctaaacttaaattttaacttcctttaactacccgtctttaccgtacgtttaccggggacgggtaacgggtaaccgttaaggggttaggaaacgtaaacggtaaccaaaaacggttcttagggtaaccggacttcggacctaccttatttccgttgtttaaccc

SEQ ID NO: 351088 - DNA, 568 bp, Homo sapiens
  misc_feature: GZ8MTXP01EIT1L.39.87.H10.1.454.CMB.2.raw
  modified_base (275)..(275): a, c, t, g, unknown or other
  misc_feature (275)..(275): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcaccgacgtctanatgcacgtggttgcgacacggcccctggacaagggcttgagtggatggatggatcaacggtacagtggtctacaaactaaaattgtagacccaagtaagtaaacggtttacgaggggtacaggggtacaaccgagtacgaaccgaaggggaacctacggtacctatacaaataacacgtaccctaagtataggggaaacctgaagcgaagggctaggagataccgtgaacgaacacggccgtagttatagttgttacggngagngtatgtatacttcttaacgttaagtaagg

SEQ ID NO: 351089 - DNA, 641 bp, Homo sapiens
  misc_feature: GZ8MTXP01BABR1.39.87.H10.1.454.CMB.2.raw
  modified_base (388)..(388): a, c, t, g, unknown or other
  misc_feature (388)..(388): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctgagtgaaggtctcctgcaaggtcttctaggaactccaccctcaccgtacgtctatatgcacgttggttgccgtaacgacggcccccgtaggaacgaagggtctttaggaggtcggagtgggatggactacgaaacggtacaggtggtctacgaactaaatttaacgngcagtaagtaacgtttcgaagggggtcacggggtacaccgatacggaaccgagggacctacgtaccaattacaaagttacgacgtacctaagacgtacgggggtaaactggaacggacgtacggcgtacggtacgacttcgtaggaaccggtcgacggggtccttaggttacgttacgttggtacggacgttaagttcgttacgtaagggtacttcttacttaccgttacgtaaggtttccggggtttaaggg

SEQ ID NO: 351090 - DNA, 512 bp, Homo sapiens
  misc_feature: GZ8MTXP01BR266.39.87.H10.1.454.CMB.2.raw
  modified_base (357)..(357): a, c, t, g, unknown or other
  misc_feature (357)..(357): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaacggtaacagtggtctcacaaaattatgnacagaagtttcaggggcagggtcacatgacagggacacgtccatcaaanacagactanagtagaactgagcgacgcgtagagacgtctacgacgacgaacgcgttgtattagtgtgcgagagaatagtaacgtactacttactaacgttaagtgg

SEQ ID NO: 351091 - DNA, 676 bp, Homo sapiens
  misc_feature: GZ8MTXP01AN30C.39.87.H10.1.454.CMB.2.raw
  modified_base (265)..(266): a, c, t, g, unknown or other
  misc_feature (265)..(266): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttcgacccagtctccatcctccctgtctgcatctgtaggagacagagtcacatcacgttcggccgggactaagtcgagggactaaattaaaatgtattagctaggtannagacaagaaaccagggaaactccgtaaggtcctagatctatcgatcgcctacgtaggtttaggaagtcgggtaccagtccgtaaggttccaggcggtataggtacggaacgttcgtaacgggaacctaggttactttcccgtaaccttcctaacacctaacctaccgaccgtacgtccgtacggccgtaccgttagtaacgtttactttacgaaccttaaacgtttacttaacgtaacgttaaacttaaaacgtttaactttaaccgttcttaaccgtccgttaacgttaccggtacgggttacggggacgggtaaacgggtaacgtaaggggtacgaaacgtaacgttaaacggtaaacgtacgttggttcgctaacgacctaactacgttcgttacttccttcgtccg

SEQ ID NO: 351092 - DNA, 621 bp, Homo sapiens
  misc_feature: GZ8MTXP01D8F5K.39.87.H10.1.454.CMB.2.raw
  modified_base (227)..(227): a, c, t, g, unknown or other
  misc_feature (227)..(227): n is a, c, g, or t
  modified_base (386)..(386): a, c, t, g, unknown or other
  misc_feature (386)..(386): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttggccggnaagtcgagggactaattaaaatgtattagcctaggtatcagacaagaaaccgaaggaaactcgtaaaggtcctagatctatgatcgcccttacgtaggtttaggaaacggtcggggtaccctagttacccgaagggttcaggtcggacgtaaggtaggngtcgtaggggactaggtactttacacttctaccacctatacccaaccgtacgtcccgtcggaccgtactaggtaacgttatttacgacttaaactttattactagttaacctaaacttaatttaacttcttacgtaccgtcttaccgtacgtttcgggacgggtaacggtaaccgagggtacgaagtaacgtaacgaaacgttgttggtcggactcgacacgttatccttgttcc

SEQ ID NO: 351093 - DNA, 542 bp, Homo sapiens
  misc_feature: GZ8MTXP01B72PN.39.87.H10.1.454.CMB.2.raw
  modified_base (251)..(251): a, c, t, g, unknown or other
  misc_feature (251)..(251): n is a, c, g, or t
  modified_base (357)..(357): a, c, t, g, unknown or other
  misc_feature (357)..(357): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagccccactcccaggtgcagctggtgcagtccgggactgaggtgaagagccgtggggcctcagtgaaggtctctgcaaggcttcnggaatcaccctcaccgacgtctatatgcactggttgcgacaggcccctggacaagggcttgagtgagtggatggatcaaccggtacagtggtctcaaactaaattntgcacagtaagtttcgagggcagggtcacatcgaccgaggacacgtcatacaatacacgcctacgataggaactggacgcgaggcgtaggaagtcgtcgtacgacggtaacgacggttccgtagttagttagtgttacggcgaggtaagtaagtcggacgttacttcgttcttaacgtttaaggg

SEQ ID NO: 351094 - DNA, 645 bp, Homo sapiens
  misc_feature: GZ8MTXP01BBZLA.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccggactgaggtgaagagccgtggggcctgagtgaaggtctccgtgacaggcttcgtaggaactccgaccctcgacccgtacgtctatatgacacgttggttcgcgacacggccccgtggaacgaggggtctttggaggtgggaagttcgggggatagggacgtacgaaacggttaacgtaggtcggtactactaaacgtaaaatttacacgcgaaacgtaagggtaaagtttccgaggggacgtaggggtacacccgtagtacggaaccgagggacctacggtaccaagtaccaaagtaccacgtacctacgaagttacggggaaacctgggacgacgagccgagagtacgtcgtaggacctaacggcggtaacgttgttaatttgttggagtacggaggttacagttaagtacgttcttacttacgttacttaacgggttgggtttaaggg

SEQ ID NO: 351095 - DNA, 505 bp, Homo sapiens
  misc_feature: GZ8MTXP01ANENE.39.87.H10.1.454.CMB.2.raw
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
  modified_base (489)..(505): a, c, t, g, unknown or other
  misc_feature (489)..(505): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactgaggtgaagagccgtggggcctgagtgaaggtctctgctaaggtcttcgaggaactccaccctcacccgacgtctatatgctacgtggttcgcgtacgacggcccctaggacaaggggcttggagtggagtggatggatacgaacggtangtggtctagaaactaatntgacactagtacgttgaggcaggtacaccagtacgacgaggaccacgtacatacaaatacgacgtactaacgagttacggaacgtggacggnggcgaggacgaacggcganagagnnnnnnnnnnnnnnnnn

SEQ ID NO: 351096 - DNA, 516 bp, Homo sapiens
  misc_feature: GZ8MTXP01CJA8N.39.87.H10.1.454.CMB.2.raw
  modified_base (362)..(362): a, c, t, g, unknown or other
  misc_feature (362)..(362): n is a, c, g, or t
  modified_base (450)..(450): a, c, t, g, unknown or other
  misc_feature (450)..(450): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggcggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttggagtggatgggatggatacaaccggtaacagtggtctacaaactaaattntagacacgtagaagtttcgagggcagggtcacgatgaccagggacacgtcatcaatacacgactacgatggaactgagcgaggctganagtctcgacgaacgcggcgtcgttagttatggttgcgagaagatgagtcttcttcttaacgttaag

SEQ ID NO: 351097 - DNA, 687 bp, Homo sapiens
  misc_feature: GZ8MTXP01B36K0.39.87.H10.1.454.CMB.2.raw
  modified_base (373)..(373): a, c, t, g, unknown or other
  misc_feature (373)..(373): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggagatcctcttctggtggcagcagccacaggagccccactcccaggtgcagctggtgcaggtccgggactggaggtagaagacgccgtggggcctcgagtgaaggtctcctgacaaggtcttcgtaggaatccaccctcaccgacgtctatatgctacgtggttgcgacgacggcccctggacagggcttgagtgagtggatggactcgaaacggtacacgtggtactacgaactaaattaacngaacaacgtaagtaacgtttacgaggggacgtacggggtaccaccgtagtacggaaccgacgggaccacggtaccaacttacgaaactacgacgaccctagacgtacgggtaacgtggaacgcgaggtccgttaggacgtaaacgtccgtacggaaccgtaaccggtaccgggtcccggttaaggtttaagtttaccggttacgggttaggaaccgggttaagggttacgttaggttaacgttaacgtttaacgttttaaccgtttaccggtttaacgttttaaggggtttaacgggggtttttaaaaccgggg

SEQ ID NO: 351098 - DNA, 602 bp, Homo sapiens
  misc_feature: GZ8MTXP01BLY7W.39.87.H10.1.454.CMB.2.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggatggagtgaagagcgtgggcctnagtgagtctctgcaggcttcgnggaactccacctcaccgacgtctatntgctcgtggtcgacgacgacggccccgtaggacgaacgggtnttggagtggagtgggatcggatacgaacggtaacngggtagtctacgaacttaaaattagngactacgaaggtacgtttcgaggggtcgagggtacacgtagtcgaccggaggacaacgtccaatacaaactacagtacctaacgtaggtaggtaacctaggacgacggtacggtcgtagaaacgtacgtaccgtaacggacggtaaccgaacgggttaccgtttagttaacgttgtagtggaacgttgagtaattgtaacgttactcttacgtaagttaaggttaacgggg

SEQ ID NO: 351099 - DNA, 577 bp, Homo sapiens
  misc_feature: GZ8MTXP01D2R1M.39.87.H10.1.454.CMB.2.raw
  modified_base (404)..(404): a, c, t, g, unknown or other
  misc_feature (404)..(404): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctcttctggtggcagcagccacaggagcccactcccaggtgcagctggtgcagtccgggactgaggtgaagaagcctggggcctcagtgaaggtctcctgcaaggcttctggaatcaccctcaccgacgtctatatgctatggttgcgtacgacggcccctggaaccaagggcttaggagtggagtgggatggatcgaacggtacagtggtctacgaaactaaattgtagcaacaagtaacgtttcgagggcagggtcaccgtanacggacaggacacgtacatacaaactacagaccctagaacgttggaactggaagcgaggtcgtaggagagtactagaaccgaacgtccggcggttaagttacgtttaacgttggttacggcgaaggtaagtagtaagtaacggtacttcgtttaacccttaagtttaacgggg

SEQ ID NO: 351100 - DNA, 570 bp, Homo sapiens
  misc_feature: GZ8MTXP01B5AYV.39.87.H10.1.454.CMB.2.raw
  modified_base (376)..(376): a, c, t, g, unknown or other
  misc_feature (376)..(376): n is a, c, g, or t
  modified_base (457)..(457): a, c, t, g, unknown or other
  misc_feature (457)..(457): n is a, c, g, or t
  modified_base (529)..(529): a, c, t, g, unknown or other
  misc_feature (529)..(529): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcagtgaaggtctcctgcaaggcttctggaatcaccctcaccgacgtctatatgctacgtggttgccgacgacggcccctggacaagggcttgaggtggatgggatggactacgaaccggtaacaggtcggtctacaaaacgtaaattntcggacaacgtaggtaagtttcgagggacgagggtcaaccgatcggaccagggaccacggtaccatacaatacgagcctanagtaggacctaggagcgaaggctaggatacgtcgacgacgaacgacggttcgttagttattagttgttacgngttagaagtgtcggtatacttactttcgttaacgttaaggg

SEQ ID NO: 351101 - DNA, 658 bp, Homo sapiens
  misc_feature: GZ8MTXP01AO0QU.39.87.H10.1.454.CMB.2.raw
  modified_base (244)..(244): a, c, t, g, unknown or other
  misc_feature (244)..(244): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagccccactcccaggtgcagctggtgcagtccgggactgaggtgaagagctggggctcagtgagtctctgcaggctcngactcaccctcaccgacgtctatatgcactggttgcgacacggcccctggacagggcttgagtggagtgggatggactacgaaccggtaacaggttggtacctacaaaacctaaatttgcgacaacgtagtaacggtttcgaggggtacgtacggggtaccaaccgagtcggaacccgaaggggaccacgtaccactacaaactacaacgtaccctaacgtaacgtacgggaacctagggaacgcggaacggccgttaggtaacgacgttacgtacggaaccgggtaaccgaaccggggttcccggttaagggttaatttaacggtttcgggttacggttacgggaaagggtaaggtaagttcgggtaaacggtttaccgttacctttaaccgtttaaccggttttaacggggg

SEQ ID NO: 351102 - DNA, 690 bp, Homo sapiens
  misc_feature: GZ8MTXP01EQRWI.39.87.H10.1.454.CMB.2.raw
  modified_base (139)..(139): a, c, t, g, unknown or other
  misc_feature (139)..(139): n is a, c, g, or t
  modified_base (251)..(251): a, c, t, g, unknown or other
  misc_feature (251)..(251): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (671)..(671): a, c, t, g, unknown or other
  misc_feature (671)..(671): n is a, c, g, or t
  modified_base (673)..(674): a, c, t, g, unknown or other
  misc_feature (673)..(674): n is a, c, g, or t
  modified_base (676)..(682): a, c, t, g, unknown or other
  misc_feature (676)..(682): n is a, c, g, or t
  modified_base (684)..(685): a, c, t, g, unknown or other
  misc_feature (684)..(685): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctnttcttggtggcagcagccacaggagcccactcccaggtgcagctggtgcaggtccgggactggaggtagaagaagccgtggggcctcgagtgaaggtctcctgcaggtctcngaactcaccctcacccgacgtctatatgactacgtggttcgaccggaaccgacggccccccgtaggaaccgaaaggggtctttaggaggttaggaagtggggatggaatacgaaacggtaacgtaggtcggtactacgtaaactaaaattttaacacgaacctaaacgtaaagggttaaacgttttacggaacggggttacgacggggtttacccaacccgtaagtaaccggaaacccggaacggggtaaccctaaccggttaccccaaagtttaaacccaaacgttaaaccgaccgtaaccctaaaccggtaaagtaacgggggggtaaaccttacggggaaacgggtccgggggaactacggggaaccccggtaaaaggggccccgaacgttaaagtaacggngngaagngngagagngnngnnnnnnngnngngng

SEQ ID NO: 351103 - DNA, 592 bp, Homo sapiens
  misc_feature: GZ8MTXP01EFM4M.39.87.H10.1.454.CMB.2.raw
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (359)..(359): a, c, t, g, unknown or other
  misc_feature (359)..(359): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcgaggtccgggatggaggtgaagagccgtgggcctcgagtgagtctctgcagcttngacncaccnacgntctatatgcacgtggtcgcgacncggccctggacaggtctggagtggagtggagtaggactacgaaacggtacgaggtcgtactacaaacgtaaaattancgacaaacgtaggttaacgttacggaggggtacgtacgggtaccaacgtagtacggaaccgacgggaaccacgtacctaagtacaacttacacgtactacgaaggtacggaacgtagacgccgaggacgtgaacgtagtaccgacggaacgacggtaacggtccgttaggttattaggtcgtagaggagagtaagtagtaacgttacgtcttacgtaacgttgggttaacggg

SEQ ID NO: 351104 - DNA, 633 bp, Homo sapiens
  misc_feature: GZ8MTXP01B63K0.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgccccactcccgaggtgcagctggtgcgaggtccgggactggagggtagaaagaacgccgtggggcctcgaggtgaaggtctctgcgaggtcttcgaggaactccaccctcaccgacgtctatatgctacgtggtcgccgacgccggccccgtaggacgaagggtcttaggaggtgggagtgggatggactacgaacggtaacaggtgtactacaactaaaattgtgacaacgtagtaaggttcgaggggacgagggtaccacgaagtacgaaccgaagggacctaccgtaccaagtaccaatacgacgtacctaacgagggtacggtaacctggaacggcgacgggtcgtaggaacgtctacggtacgaaaccggtacggaacggtccgttagttacgttagttggtacggagttagagtaagttaggtaacgtttcctactttacgtaagttgggttaacggggg

SEQ ID NO: 351105 - DNA, 703 bp, Homo sapiens
  misc_feature: GZ8MTXP01EMCPX.39.87.H10.1.454.CMB.2.raw
  modified_base (228)..(228): a, c, t, g, unknown or other
  misc_feature (228)..(228): n is a, c, g, or t
  modified_base (359)..(359): a, c, t, g, unknown or other
  misc_feature (359)..(359): n is a, c, g, or t
tcagtcgcactagtcacgaccggtgctcgatttagcagtactgcgttggggtttgggggcatcacccagcaaccacatctgtcctctagagaatcccctgagagctccgttcctcaccatggactggacctggaggatcctcttcttgggtggcagcagccacaggagccccactcccaggtgcagctgggtgcgaggtccgggatggaggtgaagagcgtgggcctnagtgaggtctctgacaggtcttgaggaactccaccctcaccgacgtctatatgcatggtgcgacgacggcccctggaacgaagggtcttaggacggtgggtagtggggataggataccgaaccgggttaanagggttaggttacctaacaaacgttaaaaaatttcgtaagaccgtaaaccgtaaaggtaaacgttttccggaagggggacctaggggttacccaaccgtaatacgggaaccgtaacgggacctaaccggtccctaaataccgtaaatacgaaccgtacctaaccgtaaggttacgggaaaaccgttggaacggacggtaccgtacggttagaaggctaccggtacgaaaccggcggaacccgggtacgttgtaaagtttcgttaggtacggttacgaggagggtaagttggttaaacggtaaccccgttttacgttaaccgttaagggtttaacgggttcgggg

SEQ ID NO: 351106 - DNA, 639 bp, Homo sapiens
  misc_feature: GZ8MTXP01BSINB.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccagggtgcagcgtggtcgcgtacggtccggactggaggtagaaggaacgccggtggggcctacgaggtaggtaacggttcctccgtggacgaacgggtcttcgaggaacctccaccctcgaccggtactactatactcgctacgttggtcgaccgacgacccgtcccgtaggaaccgaggtcttaggaggtcgagtggatggactacggtaaacgtacaggtcgtacctactaaaactaattgctaccaagtaggtagttcggagggcacggtcacgtacgcgacgaggaccacgtcactacgaaactcgacgtacacggtagtaagtaccgagccgtagcggtactaggacgtacttcggaacgaccgtaaccggtcgttaccggttaagtttacgttgtcggaaggttcgaaataagggttaatccgttatacctttcgtaaccgtttaaggttaacgggg

SEQ ID NO: 351107 - DNA, 544 bp, Homo sapiens
  misc_feature: GZ8MTXP01E4G1B.39.87.H10.1.454.CMB.2.raw
  modified_base (342)..(342): a, c, t, g, unknown or other
  misc_feature (342)..(342): n is a, c, g, or t
  modified_base (368)..(368): a, c, t, g, unknown or other
  misc_feature (368)..(368): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
  modified_base (525)..(525): a, c, t, g, unknown or other
  misc_feature (525)..(525): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagagcctggggcctcagtgaaggtctcctgcaaggcttctggaactcaccctcaccgacgtctatatgctactggtgcgacacggcccctggacaagggctgagtggagtgggatggatacgaaaccggtaanaggtggtctacaaaactaaatttaangacagagtaagtttcgagggcgacgggtcaaccgatcgaaccgagggaacacgtccaatacaactacacgcctaagagtaggaactgagcgagcgtagagagtcagaacgaacgacggttccgtagttattagttgagngagaanagtgacgttacnctttaacgaagtttaaggg

SEQ ID NO: 351108 - DNA, 582 bp, Homo sapiens
  misc_feature: GZ8MTXP01B1GXH.39.87.H10.1.454.CMB.2.raw
  modified_base (549)..(549): a, c, t, g, unknown or other
  misc_feature (549)..(549): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgaaggtcctcctgcaaggtcttcgtaggaactccaccctcgaccgtacgtctatatgcacgtggttgaccgacgaccggcccctagggaaccgaagggtctttggaagtggagtgggatggatacgaaccggtactaggtggtcacgaaactaattgtcgacaagtagtaacgtttcgaggggctagggtaccaaccgtagcgaaccgagggaccacgtaccaatacaatacagtaccctagacgtaggtaaactgaacgcgaggctacgagtacgtcgtaggaccgaacgtcggttcgtagttagttgtgttggagagngtagtgtaacgtcttacgttcgttaagttcggg

SEQ ID NO: 351109 - DNA, 690 bp, Homo sapiens
  misc_feature: GZ8MTXP01EXJ3B.39.87.H10.1.454.CMB.2.raw
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttcgacccagtcctccatccctccctgtctgctatcgtaggtagganacagacgtccacctatcctacgttcggccgganaaggtcgaagggtactaaattaaaaatgtactttagcgtaggtactcgaagacgaaacgaaaaccgaacgggtaaacctccgtaacggtcctagtacttactagtagtacgttaccgtacccttacggtaagggttttacgggtaaacgggttccggggttacccctaaggttaccggtaaacgggtttccccgaacgggtacggtacgtaggttacggtaagttccgtaaggggtaactaaggtacctttaccaccttccactacccatccacgtacgcgtacgcggtactagtattacgttcacttaattacgtacttacgaacttaattaacttacttctacgtccgtctcgtacgtcggacggacggaacgaaggtgagacgttaaaccgagtaacgttggcgttactcggtaccaacgttcttacgttcgttaaccttcgttaacccg

SEQ ID NO: 351110 - DNA, 579 bp, Homo sapiens
  misc_feature: GZ8MTXP01DEDZR.39.87.H10.1.454.CMB.2.raw
  modified_base (141)..(141): a, c, t, g, unknown or other
  misc_feature (141)..(141): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (402)..(402): a, c, t, g, unknown or other
  misc_feature (402)..(402): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctnttcttggtggcagcagccacaggagcccactcccaggtgcagctggtgcaggtccgggactggaggtagaagaacgccgtggggcctcgagtgaaggtctcctgcaaggcttgaggaactcaccctcaccgacgtctatatgctacgtggtcgcgacacggcccctaggacaagggtcttggagtggagtgggatggancgaacggtacngtgtctacaactaaaattntgacaacgagtagttcgagggcaggtcacganacgacgaggacacgtcatacgaatacacgtacctacgaggtaacgtacgtagacgcgaggcgtagaagacgttcgacgaaccggcgtaaccggtcgttagttaagttagttggacggaggttgttaaggtgttagtaacgttaccttactttacgttaacgtttgggtttaaggggg

SEQ ID NO: 351111 - DNA, 578 bp, Homo sapiens
  misc_feature: GZ8MTXP01E4G45.39.87.H10.1.454.CMB.2.raw
  modified_base (365)..(365): a, c, t, g, unknown or other
  misc_feature (365)..(365): n is a, c, g, or t
  modified_base (492)..(492): a, c, t, g, unknown or other
  misc_feature (492)..(492): n is a, c, g, or t
  modified_base (539)..(539): a, c, t, g, unknown or other
  misc_feature (539)..(539): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggatggaggtgaagagccgtggggcctcgagtgaaggtctcctgacaaggtcttgaggaactccaccctcaccgtacgtctatatgctacgtggttcgcgaccgacggccccgtagggaaccgaaggggtcttggagtggagtgggatggactacgaaacggtacngtagtactacaaactaaattgtcgacaacgtaaggtaagtttcggacgggacgacgggtacaaccgtagtacgaaccgagggaaccaccgtacaatacaatacacgacctaagagtagactagacgngaggctagagtactcgacgacgaacgtacggttcgtagttatagtgngcgagaagatggactcttacttaacgttaacgttaaggg

SEQ ID NO: 351112 - DNA, 626 bp, Homo sapiens
  misc_feature: GZ8MTXP01DM6E1.39.87.H10.1.454.CMB.2.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
tcagtcgcactagtcacgaccggtgctcgatttagcagtactgcgttgggtttgggggggagtcagacccactcaggacacagcatggacatgagggtccccgctcagctcctggggcttctgctgctctggctcccaggtgccagatgtgccatccagttgacccagtctccatcctcctgtctgcatctgtagganacagagtcacatcacttgccggnaagtcgaggacaattaaaatgattagctgtancagacaagaaaccagggaaactccgtaagtcctagatctatgatcgcctacgtaggtttagggaaacggttcgggggtaccctaagtacgtaaacggttcccgaggtcggactaggtggaactcgtggggaactagtactttcactctacacccatccaaccacgcctggccgtacctagtaagtacttttcgaacttaaactttattaactagttaactaaaacttaatttttacttcttaactcccgtacttaccgtacgtttaccggggacggtaagggtaaccgtaagggttagaacgtaacttaaaccgaaaacggtcgttaggttcggacttaagaccctaacgtattcgttcttccttctaacccg

SEQ ID NO: 351113 - DNA, 694 bp, Homo sapiens
  misc_feature: GZ8MTXP01DV07E.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagccgtggggcctcgagtgaaggtctcctgcaaggtcttcgtaggactccaccctcgaccgacgtctatatgacacgtggttgccgacgacggccccgtaggacgaagggtcttaggaggtggagttgggagtaggacgtacgaaacggtaacgtacggttcggtactaacgaactaaagttaacgtacgaactaaacgtaaacgggttaaacggtttacggacggggtacggtaacgggttaccgaaccgtagtaccggaaccggtaacggggacctaaccggtaccctaacttaaccaaactaaccgaacgtacccgtaaacgtacgtaacgggggaaacgttcgaacgaccggagtaccgagaacgatcgtaggaaccgaccggtcggtaaccggttattacgtaagtttcgagtagaaggagttagtggtaacgttccgttacgttcgttaacggtttaacggttaaggggtttaaagggg

SEQ ID NO: 351114 - DNA, 635 bp, Homo sapiens
  misc_feature: GZ8MTXP01ARKP7.39.87.H10.1.454.CMB.2.raw
  modified_base (287)..(287): a, c, t, g, unknown or other
  misc_feature (287)..(287): n is a, c, g, or t
  modified_base (486)..(486): a, c, t, g, unknown or other
  misc_feature (486)..(486): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggacgcccactcccaggtgcagcgtggtgcagtccgggactgaggtagaagaagccgtggggcctcgagtgaacggtctccgtgcaaggtcttcgtaggaactccaccctacaccgtacgtctatancgctacgtggtgcgtacgaccggccccgtaggacgaagggtctggaggtggagtggggagtaggactacggaaacggtaacgacggtcggtactacgaataaattagtacgctaacgaagtacggtttacggagggtacgtacgggtaccacgtagcgaacgacgggacaccgtacatacaaactacgacgtaccctanaacgtacgggggtaactcgggacgacgtacggcgtagacgtacgtcgtacggaccgaacggcggtcgtaaggttattagttcggagtaccggagttcgagtttcggacgttaacttcttacgttacgttaaggttaacgggtttaaggg

SEQ ID NO: 351115 - DNA, 626 bp, Homo sapiens
  misc_feature: GZ8MTXP01ADXNE.39.87.H10.1.454.CMB.2.raw
  modified_base (250)..(250): a, c, t, g, unknown or other
  misc_feature (250)..(250): n is a, c, g, or t
  modified_base (368)..(368): a, c, t, g, unknown or other
  misc_feature (368)..(368): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagccccactcccaggtgcagctggtgcaggtccggactgaggtgaagagccgtggggcctcagtgaaggtctcctgcaaggcttcnggaactccaccctcaccgacgtctatatgacctacgttggttgccgtacgaccggcccccgtgggaaccgaagggtctttaggaggtggagtggggatggatacgaacggtaacccgnggtcggtactacgtaacaaaattagtcgacaacgtaagtacgtttacgaagggctaaggggtcctaacgagtacggaacccgaagggaccaaccggttccaataccaagtaaccaggtaccctaacgagtagggaaactggaacgccgaggacgtaggacgacttcgacgaacgcgtaacggtcgttaggttaacttgtttgacgttaggagttgaagtgttaacgttcttcttaccgttaacgttggtttaaggggg

SEQ ID NO: 351116 - DNA, 653 bp, Homo sapiens
  misc_feature: GZ8MTXP01DRBRD.39.87.H10.1.454.CMB.2.raw
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
tcagtcgcactagtcacgaccggtgctcgatttagcagtactgcgttgggtttgggggggagtcagacccactcaggacacagcatggacatgagggtccccgctcagctcctggggcttctgctgctctggctcccaggtgccagatgtgccatccagttgacccagtctccatcctccctgtctgcatcgtgtaggagacagatcaccatcacgttgccggganaagtcgagggactaaattaaaaatgtaattagctaggtancagacaagaaaccgaagggaaactccgtaagtcagatctatgactcgtcctacgtaggtttaggaacggttcgggtacccagtacgtaaaggttccgacggcggagtaggtaggtaacttacgtggggaactagggtactttaccgaactctaccacctatacccaacctcgcctcggtacggacttaggtaattacgtttagacttaactttaacttactacgtaaacttaaatttaactttaactttacgttacctaccgtacttacctaccggtttcggggacggttaacgggaacgtaaagggtcggttaaacgtacgttaaaccgaaaacgggtttcttcgggttcgactaacgactaactcgttcttcttccttaaccgtc

SEQ ID NO: 351117 - DNA, 819 bp, Homo sapiens
  misc_feature: GZ8MTXP01ESPC8.39.87.H10.1.454.CMB.2.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (792)..(792): a, c, t, g, unknown or other
  misc_feature (792)..(792): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtagganacagacgtcaccatcacgttggccggganaagtcgaagggactaaattaaaaatgtaatttagccgtaggtaatcaagacaaacggaaaaccgaagggtaaaactaccgtaaaggtcctagacttactatcgatcgacccttacgtaaggtttacgggaaacggttcggggtaccctaagttaccgtaaaggttaccccgaaggtaccgggtacgtaagggtacggtaaacgttcggtaagggggtaaactaagggttaaaccttttaccgaacttaccctactaaacccctacttaacccaacccgtaacgggtcccgttcgggacccggttaaccgttaagggttaaacgtttacggtttttaacgaaacctttaaaacttttaaacgttacccgtttaacgttaaacctttaaaaaattttaaactttttaaacggtttcccttaaaccttccccggtttacctttaaccgttacccgggttttacggggaaacccgggtaaacggggtaaacccggtaaagggttaagggaaactaaacgttaaacccgtaaaagtaccgttagggttccgactaacggactaaaccctntttcgttacgttcctttaacgtaaccg

SEQ ID NO: 351118 - DNA, 766 bp, Homo sapiens
  misc_feature: GZ8MTXP01AYJLM.39.87.H10.1.454.CMB.2.raw
  modified_base (278)..(278): a, c, t, g, unknown or other
  misc_feature (278)..(278): n is a, c, g, or t
  modified_base (293)..(293): a, c, t, g, unknown or other
  misc_feature (293)..(293): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctcttctggtggcagcagccacaggacgcccactcccgaggtgcagctggtgcaggtccggactgaggtgaagagccgtggggcctcgagtgagtctctgacaggtctcgtggaactccaccctcaccgacgtcttatntcgctacgtggttcncgacacggcccctaggacaagggtcttggaggttcggagtcgggtatcggaactacggaaacccggttaactaggttacggtacctaaccgaaaaacgttaaatttcgacgaaccgtaaacgtaaacggttaggtttaccggaagggggtacccgtacggggttaccaaaccggtaacgttaccggggaaacccggtaacggggaaccccttaaccggtaccctaacgttaaacccgaacgtaaacccgtaacgtacccccgtttaaaggaacgggttaacggggaaaccttacgggaacggaccgtacgggtacccgtaagggtacgtaaccgttacggtaacggacccgggtaaacccgtcgggttacccgggttaagtttaaaccggtttagttaacgggttacggacgttaagggaaggttacgtaacggttacggtaccttacgtttaaccgttaaggtttaacgggg

SEQ ID NO: 351119 - DNA, 639 bp, Homo sapiens
  misc_feature: GZ8MTXP01E3LWR.39.87.H10.1.454.CMB.2.raw
  modified_base (378)..(378): a, c, t, g, unknown or other
  misc_feature (378)..(378): n is a, c, g, or t
  modified_base (479)..(479): a, c, t, g, unknown or other
  misc_feature (479)..(479): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctgagtgaaggtctcctgcaaggtcttctggaatccacctcaccgacgtctatatgctacgtggtcgcgacgacggccccgtaggacgaaggtcttagaggtggagttgggatggatacgaaacggtaacgtagtaggtctacaaacaaagttaanacgaactaacgaaaggtaaaccgtttgacgggtacgacgggacccacgagtacgaaccggaagggaaccctacgtacccaattacaaacacacgacctaanagtacggggaaatgaagcgaggccgtaggaagtatgtaggaaccgacgaacccggtggtaagtttagttacgtttggtacggtacgaaggttaagttacgttaagtaaggttaacctttccgtacgtttaaacgttcgggtttaaggggtttaacggggg

SEQ ID NO: 351120 - DNA, 610 bp, Homo sapiens
  misc_feature: GZ8MTXP01A270C.39.87.H10.1.454.CMB.2.raw
  modified_base (246)..(246): a, c, t, g, unknown or other
  misc_feature (246)..(246): n is a, c, g, or t
  modified_base (383)..(383): a, c, t, g, unknown or other
  misc_feature (383)..(383): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtgggcctgagtgagtctcctgcaggcttcgnggaactccaccctcaccgacgtctatatcgctacgtggttgccgacgacggcccctaggacgtaaggggtcttaggaggtcggagtggggattggaacgtacgaaacggtaccgaggtcggtctaacactaaaattngacaacgtagtaacgttcgaagggctacgggtacaacgatacggaaccgaagggacctaacgtaccaatacaaacgttacgaacgttctaacgacggtaggaaactggaaacgcgagcgttaggaatacgtcgacgacgaacgcggtcttagtaatttggtagtcgacgttaggttagtaagtcggtaagttcctacgtttacgtaacgtttgggttttaacggggg

SEQ ID NO: 351121 - DNA, 605 bp, Homo sapiens
  misc_feature: GZ8MTXP01ENHEL.39.87.H10.1.454.CMB.2.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (560)..(560): a, c, t, g, unknown or other
  misc_feature (560)..(560): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccggactgaggtagaagagccgtgggcctcgagtgaggtctctgcagtctngactcaccncacgactntatatgctacgtggttcgcgacgacggccccgtaggacgaaggtcgttagacggtggagtgggataggatacgaaaccggtagaggtgtactacaaactaattcgtagactagtaaggtaacgtttacggaacgggtacgacgggtacaaccgtagtacgaaccgacgggaacctaccggtacagtacaaacgtacacgtaccctaagtacgtaggtaactggacgaccgaggtaccgtagacgtacgtcgtacggaccgaacgtacgggttcgttagttagttagtggttacgngagtaagacgtaagtacttcgttacgttcgttaagtttaacgggg

SEQ ID NO: 351122 - DNA, 623 bp, Homo sapiens
  misc_feature: GZ8MTXP01CMDHK.39.87.H10.1.454.CMB.2.raw
  modified_base (544)..(544): a, c, t, g, unknown or other
  misc_feature (544)..(544): n is a, c, g, or t
  modified_base (581)..(581): a, c, t, g, unknown or other
  misc_feature (581)..(581): n is a, c, g, or t
  modified_base (589)..(589): a, c, t, g, unknown or other
  misc_feature (589)..(589): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacgaggacgcccactcccaggtgcagctggtgcaggtccggactgaggtgaagacgccgtggggcctcgagtgaacggtctccgtgactaaggtcttacgtggaactccacccctacaccggtacgtactagtactgctacgttggttcgacggtacgacggccccgtagggaaccgaaggggtccttaggaggtgggagtgggatggatacggaaaccggtacgagttcggtactaccgtaaaactaaattcgcgtaacacgtaaggtaagtttacggacgggacgtacgggtaccacgtagtacggaaccgtagggaactacgtacaactacaacacacgaccctagacgttaggaactgacgtacgcgacgtagaacgtntacgacgacgaacgtacgcggttattacgtgttcggngcgaaggntacgtgtactcgttcgttaacgttaagtttcggg

SEQ ID NO: 351123 - DNA, 700 bp, Homo sapiens
  misc_feature: GZ8MTXP01DG6IR.39.87.H10.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (264)..(264): a, c, t, g, unknown or other
  misc_feature (264)..(264): n is a, c, g, or t
tcagtcgcactagtcacgaccggtgctcgatttagcagtactgcgttgggtttgggggggagtcagacccactcaggacacagcatggacatgagggtccccgctcagctcctggggcttctgctgctctggctcccaggtgccagatgtgccatccagttcgacccagtcctccatccctccctgtctgcatctgtagganacagagtcaccatcacgttgccgggnaagtcagggactaaattaaaatgtattagctagtancagacaagaaaccgaagggaaaacctccgtaaggtcctagatctatgatcgtcctacgtaggtttagggaaacggtcgggtaccctagtacgtaacggttccgacggcggacgaggtcggaaagtacgtggggaactacggtactttccgaccttcctacaccctactaccaacccgtacggtcccgtggacccggtaccttagggtaaactttacgttttacgacttaaaccttttaagttaaccttaggtttaaaaccctaaaacttttaaattttaactttaccctttaacgtccccgtacgtttacccttacgggtttccggggacgggaacgggtaaaccgtaagggtaccgggaataaccggttaaacgtaaaacggtcgttagggttgccgtaacaaccttccgattcgttacgttcttccgttaaccc

SEQ ID NO: 351124 - DNA, 563 bp, Homo sapiens
  misc_feature: GZ8MTXP01B206W.39.87.H10.1.454.CMB.2.raw
  modified_base (143)..(143): a, c, t, g, unknown or other
  misc_feature (143)..(143): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctnttcttggtggcagcagccacaggagcccactcccaggtgcagctggtgcaggtccgggactgaggtgaagagccgtgggcctgagtgaggtctctgcaggtctngaatcaccctnacgcgtctatangcagtggtncgacgcgccctggacgaggtctgngtggagtgganggactcgaaacggtacagtgtactcgaaactaaattngacacgagtacgttcgagggcagggtccaacgatcggaaccgagggaaccacggtacaacgtacaaacgtacgaacgtaccctaaaggacgttaaggggaaacctggacgaccgtggactaaggacgtactcgtacgacgaacgacggttcgttgttacgttagtcgngngagtaagagtcgaacgttcttcttaacgttaacgtttaaggg

SEQ ID NO: 351125 - DNA, 582 bp, Homo sapiens
  misc_feature: GZ8MTXP01C48I3.39.87.H10.1.454.CMB.2.raw
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccggactggaggtgaagagcgtggggcctcagtgaaggtctccgtgacaaggtcttacgtggaactccaccctcaccgacgtctatatgactacgtggtgcgacgacggcccctaggacgaagggtcttaggaggtggagtgggatggaatcgaacggtacaggtagtctacaactaaaattatggactaacgaaggtaaacgtttcggaaggggtacgacgggtaccaacgagtacggaaccgaagggaccaacgtaccatacaatacacgacctaacgaggtacggaactaggacgcggagcggtagaaacgtgtaccgagacgacgaacggtcgttagtattgtgngagngagaatgtaatacgtcttagtaagttggttaaggg

SEQ ID NO: 351126 - DNA, 596 bp, Homo sapiens
  misc_feature: GZ8MTXP01AQWLY.39.87.H10.1.454.CMB.2.raw
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (490)..(490): a, c, t, g, unknown or other
  misc_feature (490)..(490): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcgacggtccgggactggaggtgaagagccgtgggcctcgagtgaggtctctgcaggcttcgnggaactccaccctcaccgacgtctatntgactagtggtcgaccgacgaccggccccgtaggacgtagggtcttggaggtggagtgggtatggatacggaaaccggtacnggtcgtctacgaaaataagttngacaagagtagttcgagggcgaggccacgntacgacgaggaaccncgtacagtaccaaagtaccgaacgtcccgtaacgacgttacggggaaacctgggaaccgngacggtctaggagtactcgacggaccgtaacggtcgttcggtgttacgttagtcggngngagtgtattcgggaaccttacgttacttaacgttaagttttaacggg

SEQ ID NO: 351127 - DNA, 626 bp, Homo sapiens
  misc_feature: GZ8MTXP01D0EWO.39.87.H10.1.454.CMB.2.raw
  modified_base (227)..(227): a, c, t, g, unknown or other
  misc_feature (227)..(227): n is a, c, g, or t
  modified_base (361)..(361): a, c, t, g, unknown or other
  misc_feature (361)..(361): n is a, c, g, or t
  modified_base (432)..(432): a, c, t, g, unknown or other
  misc_feature (432)..(432): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccggatggaggtgaagagccgtggggcctnagtgagtctctgacaggtcttcgtaggaactcaccctcaccgacgtctatatgcacgtggtgcgacgcgcccgtggacgaggtctggagtggagtggatggatacgaacgtacgagtgtctacgaaactaatgngacaacgtagtaacgtttcggacggggtacgacgggtacaccgtagtacggaccgaaggtaccacgtcaanactaactacacgcctaagactaggaactgacgcgagggtaccagggactagttcgacggaaccgaaccggtaacggttcccggttagtttaaagtttaccggtttacggttaggttaccggttaaggtaaggttaagttcggttaaaccggttaccttttacgttttaacccgtttaacggtttttaacggggg

SEQ ID NO: 351128 - DNA, 633 bp, Homo sapiens
  misc_feature: GZ8MTXP01DNHBZ.39.87.H10.1.454.CMB.2.raw
  modified_base (249)..(249): a, c, t, g, unknown or other
  misc_feature (249)..(249): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggatgaggtgaagagccgtgggcctgagtgaggtctcctgcaggcttcgnggaatccaccctcaccgtacgtctaatatcgctaccgtggttcgccggaaccgacggcccccgttagggaaccgaaaggggtcctttaggagggttggaggttgggaactaggactacgtaaaaccggtacctaggttcggtactaccaaaactaaagttgtcgacaaacgtaggtaacgtttcgaggggtcgtacgggtacaaccgagtacgaacgtacgggacaccgtacatacgaatacacgtacctaagtagtacggaactgacgcgaagcgtagacgtatcgaacggacccgaagtccggttcgttagttaagttagttggcgaggaaggtaagtaagtcggtaagttccttacgtttaacgttaacggtttaaggggg

SEQ ID NO: 351129 - DNA, 649 bp, Homo sapiens
  misc_feature: GZ8MTXP01BJ3D5.39.87.H10.1.454.CMB.2.raw
  modified_base (416)..(416): a, c, t, g, unknown or other
  misc_feature (416)..(416): n is a, c, g, or t
  modified_base (496)..(496): a, c, t, g, unknown or other
  misc_feature (496)..(496): n is a, c, g, or t
  modified_base (554)..(554): a, c, t, g, unknown or other
  misc_feature (554)..(554): n is a, c, g, or t
  modified_base (609)..(609): a, c, t, g, unknown or other
  misc_feature (609)..(609): n is a, c, g, or t
tcagtcgcactagtcacgaccggtgctcgatttagcagtactgcgttggggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactgaggtgaagagccgtggggcctcgagtgaggtcctcgtgacgaacggtcttcgaggaactccaaccctcgaccgtacgtctatatgcacgtggttcacgacgaccggcccctagggacgaagggtcgttaggacggttgggagttagggtatacggggtagtaccgaaacgggttaaactagggtggtacctacccaaaaataaagtttncggaacctaaacggtagttaaacggtttcggaaacgggggtctacggggttcaaccgtagccggaaaccggtagggaacncccggtaacattacaaactacgaacgtaccctagagtacggaactaggacgcgaggcnggacgtctacgtaggaccgaagaccggttgtattaacgttgtcgttgacgaggtnaacgttgaagtttccgttattaacggttaacgtttaaggg

SEQ ID NO: 351130 - DNA, 682 bp, Homo sapiens
  misc_feature: GZ8MTXP01CWW8D.39.87.H10.1.454.CMB.2.raw
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaaagacgccgtggggcctcagtgaaggtctctgcaaggcttcgaggaactccaccctcaccgacgtctatatgcacgttggttcgcgacgacggccccgtaggaccgaagggtcttaggaggtggagtgggatggatacgaacggtaacnggtcgtactnaactaataatgcaagagtaagttcggaggacgtagggtaccacagtaccggaacgtacggggaacctaaccggtaccaacgttaccgaaatacccgaaacgtaccctaaaccgtaacgggtaacggggtaaaccgttacgggaagaccggaagggtccgtaaggaacggtaaacgtcccgtaagggaacccgaccggtaacgggtccgttaagttacgttagttggtacggtacggttaagttaggttacggttaacgtaacggtttaacctttaccgttacgttaacgtttcggttaacgggggttttaaaccgg

SEQ ID NO: 351131 - DNA, 619 bp, Homo sapiens
  misc_feature: GZ8MTXP01AJTUB.39.87.H10.1.454.CMB.2.raw
  modified_base (241)..(241): a, c, t, g, unknown or other
  misc_feature (241)..(241): n is a, c, g, or t
  modified_base (558)..(558): a, c, t, g, unknown or other
  misc_feature (558)..(558): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacgaggacgcccactcccaggtgcagctggtgcagtccggatgaggtgaagagcgtgggctgagtgagtctctgcagcttgngaactcaccctcaccgacgtctatatgctacgtggtcgaccgacgaccggccccgtaggacgtaggtcgttaggaggtggaggtagggatgggatacggaaacggtaaccgaggtggtctacaataaaattgtcgaacaacgtaggtaacgtttaccggaggggtacgtagggtccaaccgtagtaccggaaccggacggaacctaccggtactaactaaccaaacgttaccgacgtaccccttagaacgggtacggaacgtaggacgacgaggtcgaggaacgtacgtcgacgaccgtcgtaacggtcgttagttnttcgtaggtcgaggagaagtgtagtcgttacttcgttacgtaacgttaaggttaacggggg

SEQ ID NO: 351132 - DNA, 696 bp, Homo sapiens
  misc_feature: GZ8MTXP01EFZZO.39.87.H10.1.454.CMB.2.raw
  modified_base (646)..(646): a, c, t, g, unknown or other
  misc_feature (646)..(646): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcgaggtccgggactggaggtagaagacgccgtggggcctcgagtgaaggtctcctgacgaaggtcttcgtaggaactcccaccctcgaccggtactctatatggctacgtggttcgacgaccgacggtcccctaggaccgaagggtccgttaggaggttagggagttaggggagtaggaactaccgtaaaccgggtacaggttcggtacctacgtaaaacttaaatttcgacgacctaacgaagttaacggtttacggagggggtacgtaacggtccaaccgtacgtaacggaaccggtacgggaactaccgtaccaattacaaacttacaacgacctaacgaagtacggaacgtcggacgaccgaggacgttagacgtactacggacgtaacggaacccgtacgggttaccgtttagttaaacgttgttacgggcgttagggaaggtaaggtntaacgggttacgttcttaccgttttaaccgttaacgggttttaacggggg

SEQ ID NO: 351133 - DNA, 554 bp, Homo sapiens
  misc_feature: GZ8MTXP01BQQ2G.39.87.H10.1.454.CMB.2.raw
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (329)..(329): a, c, t, g, unknown or other
  misc_feature (329)..(329): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaggtctctgcaggctngatcacctcaccgntctatatgcactggttgcgacacggcccctggacaaggtcttgagtggatgggatggatacgaacggtanagtgtctacaaactaattgtgacacgtagtaacgtttcgagggcagggtcaccgagtcgaccgaggacacgtacatacgaactacacgtcctaacgagtacggtaacctggaacgcgaggtcctaggagtacgtcgtacgacgaacgacgggccgtagttacgttagttcggttggcggagtaagagtaacggtaaggttccttacgttcgttaacgtttaaggg

SEQ ID NO: 351134 - DNA, 715 bp, Homo sapiens
  misc_feature: GZ8MTXP01DL53Z.39.87.H10.1.454.CMB.2.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttcgacccagtctccatccctccctgtctgcatctagtagganacagagtcacatcacgtcggccgganaagtcgagggactaaattaaaatgtattagctagtatcagacaagaaaccgaggtaaactcgtaagtctagatctatnatcgaccttacgtaggtttaggaacggtcggtaccagtaccgaggttcgaggcgtacgaaggtggtgtcgtagggactagtacttacacctacacctaacctactccaacccgtcgtacccggtcggaccggttaccgtaaggttaaacggttactttttacggaaaccctttaaactttttaaacgggtttaacccgttaacgtttaaaacctttaaaacgttttaaaatttttaaacccttccgtttaaaccttccccgggtaactttaccgggttaccggtttacgggggacccgggtaaacggtaaaccggttagggggtaacgaacgtaaaccgtaacgttaaaaacgggttcgttcgggtcgtaacctcgtaacctacgttctttccgttcgtttaacccg

SEQ ID NO: 351135 - DNA, 659 bp, Homo sapiens
  misc_feature: GZ8MTXP01AN8M6.39.87.H10.1.454.CMB.2.raw
  modified_base (361)..(361): a, c, t, g, unknown or other
  misc_feature (361)..(361): n is a, c, g, or t
  modified_base (386)..(386): a, c, t, g, unknown or other
  misc_feature (386)..(386): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgaggtccgggactggaggtagaagaagccgtggggcctgagtgaggtctctgcaggtctgtggaactcaccctcaccgacgtctatatgacacgttggttcgccgacgacggcccctaggaccgtaagggcttggaggtggagtggacgtaggatacgaaaccggtacnggtaggtacctacgaaactaaattntcgactacgaagtacgttacgagggacacgggtacactagtacgaaccgaggaacaccgtaccactacaaactacgacgtacctaacggagtaggaaccaggaacgccgtaaggtaccgtaggaaacgtacgttacgtaacgggaaccgaaccgtacgggttacccgttagttaaccgtttacggtttaggacggttaccggttaagggaaagttaggttaacggttaacgttacccggtttaactttccgttaaaccgggttttaaaggggg

SEQ ID NO: 351136 - DNA, 681 bp, Homo sapiens
  misc_feature: GZ8MTXP01BE3JF.39.87.H10.1.454.CMB.2.raw
  modified_base (249)..(249): a, c, t, g, unknown or other
  misc_feature (249)..(249): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgaggtccgggatgaggtagaagagccgtggggcctcgagtgaggtctctgcaggctnggactcaccctcaccgacgtctatatgcacgtggttcgacgacgacggtcccccgtgggaaccgaaggggtcttaggaggtggagtggggaatggaataccgaaaccggtactaggtcggtacctactaaaacttaattgacgactaacgtaggttaacgttcgggacgggtacgtacgggtaccaaccgtagtacggaaccggtacggaaccctacgtacctaacgtaacaacgtaaccgacgtaccctaaggaacgtacggaacgtgacggtacgaggtacgaagtacgtacgtccgttaacggaacccggtaacgtaacccgggttcgttaaggtttaacgttttagggtaccggttaggaacggttagggtaagttaggttcgggtaactttacgtttaccgtttaacggtttaacggtttaaggggg

SEQ ID NO: 351137 - DNA, 670 bp, Homo sapiens
  misc_feature: GZ8MTXP01BE940.39.87.H10.1.454.CMB.2.raw
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcgtcttcttggtggcagcagtcacaggagcccagtcccaggtgaacttggtgcagtctgggtttgaggtgaagaagccgtggggcctcgagtcgaacggtcccctgccaggtcttctaggatacatcttcagcgtcctattatactacacgtgggtncgtccaggcccctggacaagggcctgagtggntgggatgtactaccgaaacccggagtacggtccggacgtaacaaacctaaaagtagtaacgaccgaacgaagggtaaacgtacgtttacggaggggtacgtaacggggtaccaacccgtagtacggaccggtacgggaaccacgtaccaaactaacgaaaaccgtacgtacctaaacgtagtaacggtaacttacgaagggttaacaacgtacgtaacgtaccgaaacggtaccgaaccggtcgttacgtacgttccgtaagtcgaccggagacgggtacgaacggttcgttacccgaggtaaggggtataaggtcggaccgtttagttcgttaagttttgggg

SEQ ID NO: 351138 - DNA, 777 bp, Homo sapiens
  misc_feature: GZ8MTXP01BVIDP.39.87.H10.1.454.CMB.2.raw
  modified_base (255)..(255): a, c, t, g, unknown or other
  misc_feature (255)..(255): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcgaggtccgggactggaggtagaagaagccgtggggcctcgagtgaaggtctcctgcaggcttcgnggaactccaccctcaccgacgtctatagtgcctacgttgggttcgaccggaacgaccggggtcccccgtaggggaaccgaagggggtcttagggaggtgggtagtgggggaacttagggtaaactaccggaaacgggttaacccgtagggttacggtacctacaaacgttaaaaaattacgtcgggaacctaaaccggtaaagggttaaacggttttaccgggaacgggggtaccgtaacggggttacccaaccgtaacggttaccgggaaacccggaacgggggtaaaccctaacccgggttacctaataaccgtaaacgtaacccgaacggtaccctaacgtacggggttaacgggaaacgttacgggacgaccgagggtactacggaagtacgttaccggacggaaccggaccggtaaccgggttccgttaaggtttaatttaacggtgggtacgttacgggagttagtaagtaggtaacgttacttcgtttacgttaaggttaaggttttaacggggg

SEQ ID NO: 351139 - DNA, 844 bp, Homo sapiens
  misc_feature: GZ8MTXP01DK4SO.39.87.H10.1.454.CMB.2.raw
  modified_base (766)..(766): a, c, t, g, unknown or other
  misc_feature (766)..(766): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggagatcctcttcttggtggaagcagccacaggacgcccactcccaggtgcagcgtggtgcaggtccgggactggaggtgaaagaagccgtggggcctcgagtgaaggtctctgcaaggtcttcgaggaactccacccctcaccgtacgttctaatatgctacgtgggtgaccgaacgacgggccccctaggggaactaaggggctttaggaggtgggtagtagggggtaacgtaggaactaaccggaaaaccgggttaaatacggggtttaccggtaacccttaacggtaaaacttaaaatttacggtaaccgtaacctaaacggtaaagggttttaaaacgggtttaccggggaaacgggggtacggtaaccggggttacctaaaccgacgttaacgggaaacccggtaacggggaaacccttacccggtaaaccaaacgttaaacccgaaaattaacccgtaaccgtaacccgtaaacgtacggttaaaccgggtaaacgggtaagggaacgtaccgggacgggtacccgtaagggtactaccgtaccggttaaccggtaaacccggtaacggtacccgggttacggtttaagttttacgttacggtttacggaggtaaacggaaggttaaacgnggtttaacgtaacgtttaccgtttaaccctttaggttaacgtttacggggtttaagggggtttaacgggtttaaaagg

SEQ ID NO: 351140 - DNA, 576 bp, Homo sapiens
  misc_feature: GZ8MTXP01CUDLJ.39.87.H10.1.454.CMB.2.raw
  modified_base (255)..(255): a, c, t, g, unknown or other
  misc_feature (255)..(255): n is a, c, g, or t
  modified_base (378)..(378): a, c, t, g, unknown or other
  misc_feature (378)..(378): n is a, c, g, or t
  modified_base (490)..(490): a, c, t, g, unknown or other
  misc_feature (490)..(490): n is a, c, g, or t
  modified_base (541)..(541): a, c, t, g, unknown or other
  misc_feature (541)..(541): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagaagccgtggggcctgagtgaaggtctctgcaaggtcttcnggaactccaccctcaccgtacgtctatatgcacgtggtcgcgacgacggccccgtaggacgaagggtcttggagtggagtgggatggatacgaaccggtacaggtggtactacaaactaattngacacgtagtacgttcgagggcgagggtcaccgagtacgaccgaacgggacacgtaccaagtacaaatacacgaccttaaggagtacggaactggagcggagcgtagagtancgtacgacgaacgtcggttcgttagttagttagtgttaggcgttagaagtntaacggtacttacgttcttaacgttcgtttaaggg

SEQ ID NO: 351141 - DNA, 649 bp, Homo sapiens
  misc_feature: GZ8MTXP01DQQ2X.39.87.H10.1.454.CMB.2.raw
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (567)..(567): a, c, t, g, unknown or other
  misc_feature (567)..(567): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctgggtgcaggtccgggactgaggtagaagaagccgtggggcctcgagtgaaggtctcctgcaaggtcttcgtggtacctacctttacaactatggtatcgaggttggngcgacnggcccctggacagggcttaggagtggagtgggatggatcgagcgacttacatggtacaacacaaaactatcgacaacgaaacgaacccgtcgaggggactaagacgtacacccaagtacgaaccaacgaacgaacaacacgtacccaaacgacgaccgaacccggtacctaacgtaacgttcggaacccgtggaacggtacgacccgtaggacgtactcggtacgaaccggtaaccgaaccggttccgttaggttaaacgtttccgnggttacgcggaaaggtaacgggtaaggttaacgggggttaaaatttacggttttacggtaaccgttttcggggtttaacccc

SEQ ID NO: 351142 - DNA, 634 bp, Homo sapiens
  misc_feature: GZ8MTXP01AM5PR.39.87.H10.1.454.CMB.2.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccaggactggaggtgaagaagccgtggggcctcagtgaaggtctcctgcaaggcttcnggaactccaccctcaccgacgtctatatgcactggttgcgacncggcccctggacagggtctggagtggagtgggatggatcgaacggtaaccgaggtggtctaccgaactaaaaaaagttatcggacctaaacgaggttaaacggtttcgaacgggggtcgaacgggggtccaaccgagttaccggaaccgtaacgggaaccctacggtaccaacgttacaaacttaccgaacgtacctaacgaggtacggaactaggaacgtacgacggcgtggaagtactccgtaggacgaccggtaacgggtcccgttaggttaacttagttcggtaggttacggagaggtaatagtaacgtcttacttacgttaacgttaagtttggggg

SEQ ID NO: 351143 - DNA, 645 bp, Homo sapiens
  misc_feature: GZ8MTXP01EI3XN.39.87.H10.1.454.CMB.2.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctnagtgaagtctctgcaggctntggatccacctcaccgacgtctatatgacacgtggtgcgacgacggccccgtggaacgaagggtcttggaggtggagtggatggatacgaaaccggtacaggtcggtctacgaaaactaaattgtacgacgtaaacgaagggttaaacggtttcggaaacgggggtcgtaacgggggttaccaaccgtaagtacggaaccggaacggggtaacctaccgttacaactaccaaacgtacaacgtaccctaaggtaacgtaggaaaccgttggacgccggagtacggacgacggtacgtacgtaacggacgaacgtccggttacgtaggttacttaaggttgttcggacgagggaagtataagggtaaccctttacgttacgtttaacgttaacggtaagg

SEQ ID NO: 351144 - DNA, 711 bp, Homo sapiens
  misc_feature: GZ8MTXP01EMHT9.39.87.H10.1.454.CMB.2.raw
  modified_base (143)..(143): a, c, t, g, unknown or other
  misc_feature (143)..(143): n is a, c, g, or t
  modified_base (202)..(202): a, c, t, g, unknown or other
  misc_feature (202)..(202): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctccaggtncagatgtgccatccagttcgacccagtcctccatccctccctgtctgcatctgtagganacagatcaaccatcacgttcggaccgggactaaggtcgaagggtactaaaattaaaatgtaattacgctaggtatcaagacaaggaaaccgaagggtaaaacctcgtaaacggtctagtactacgtactagtactcgtaccccttaaggttacggttaagggtaaaccggttcggggaccctaagtaccgaaggttcaggtcggctaaaggtgtaacgtgtaggggaactacgtactttcacttcgtaccactagcccacacgtcctcggactactagtaattactttcgaacttaactttaacggtacttataaaccttaaatttaaactttcccttacggttaactacccgtctttaaaccggttaccggtttacgggggaccgggttaaaacgggggtaccgttaaaagggggtacgttaaacggttaactaaaacccgggaaaacgggtttccggttgggttaacggacctaacggtacctacgttcgtttcctttccgttaacc

SEQ ID NO: 351145 - DNA, 613 bp, Homo sapiens
  misc_feature: GZ8MTXP01DZ915.39.87.H10.1.454.CMB.2.raw
  modified_base (345)..(345): a, c, t, g, unknown or other
  misc_feature (345)..(345): n is a, c, g, or t
  modified_base (468)..(468): a, c, t, g, unknown or other
  misc_feature (468)..(468): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagagcctggggcctcagtgaaggtctctgcaaggcttctggactccaccctcaccgacgtctatatgctacgtggtcgcgacgacggcccctggacgaagggtcttgagtggagtggatggactacgaaacgtacgnggtcggtactacaaactaaattagtacgaacaacgtaaggtaaacggtttcgaaggggtacgacggggtaccaaccgtagtacggaaccgagggtaccacgtaccagtacaatacagacctanacgtagggaactggaagcgagcctagagtactcgtagaccgacgtcggaacgtttagttagtttacgttggtacgcgttaaggttacgttaagttgtacgttaaccttcttacgttaacgttaaggttcggggttttaaacgggg

SEQ ID NO: 351146 - DNA, 630 bp, Homo sapiens
  misc_feature: GZ8MTXP01AQHP8.39.87.H10.1.454.CMB.2.raw
  modified_base (606)..(606): a, c, t, g, unknown or other
  misc_feature (606)..(606): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagcgtgggcctcgagtgaggtctcctgcaaggcttctggaactccgaccctcaccgacgtctatatgctacgtggttgaccgacgacggcccctaggacgaagggtcttggagtggagtgggataggatcgaaacggtaacaggtggtactacaataaaacttgtgactaacggtaagtaacgtttacgaggggtacgtaacggggtacctaacccgagtacgaaaccccggaaggggaaacctacccggtacctaagtaacctaaacgtaaaccgtaaccggaccttaacgaacggttaacggaaaaccgtgaacgtacgaggtcgaggtaagtacgtcgtagaccgtacggaacggcttggtaattgtggtcgttgagttagaatagtgtacctnttaccgtaagttaagttaaggggg

SEQ ID NO: 351147 - DNA, 620 bp, Homo sapiens
  misc_feature: GZ8MTXP01DCNLC.39.87.H10.1.454.CMB.2.raw
  modified_base (292)..(292): a, c, t, g, unknown or other
  misc_feature (292)..(292): n is a, c, g, or t
  modified_base (552)..(552): a, c, t, g, unknown or other
  misc_feature (552)..(552): n is a, c, g, or t
  modified_base (567)..(567): a, c, t, g, unknown or other
  misc_feature (567)..(567): n is a, c, g, or t
  modified_base (593)..(593): a, c, t, g, unknown or other
  misc_feature (593)..(593): n is a, c, g, or t
  modified_base (600)..(605): a, c, t, g, unknown or other
  misc_feature (600)..(605): n is a, c, g, or t
  modified_base (607)..(620): a, c, t, g, unknown or other
  misc_feature (607)..(620): n is a, c, g, or t
tcagtcgcactagtcacgaccggtgctcgatttagcagtactgcgttggggtttgggggagcatcacccagcaaccacatctgtcctctagagaatcccctgagagctccgttcctcaccatggactggacctggaggatcctcttcttggtggcagcagccacaggacgcccactcccgaggtgcagctgggtgcgaggtccgggatggaggtagaagacgccgtgggcctgagtgaggtctctgcaaggtctcgtaggactccaacccctcgaccgtagttctaatacgntcgtacgtggttcgccgaaccgcggccccgtagggaacctaagggggtctttagggaggttggaggttaggggaataggggtaactaaccgggtaaaccggtaactaggttcggttaacaccgtaaaaaattaaattaagtacggaaacctaaagttaagggtaaggtttaccggagggacgaacgggtaccaaactacgtaacgacccggaagggaaccctaacggtaccaataaccaacgtacacgtacccgtaaagngttaacggggaacgngggacgggacgagtaggaacgacgtnaagaagnnnnnngnnnnnnnnnnnnnn

SEQ ID NO: 351148 - DNA, 594 bp, Homo sapiens
  misc_feature: GZ8MTXP01D0NJV.39.87.H10.1.454.CMB.2.raw
  modified_base (222)..(222): a, c, t, g, unknown or other
  misc_feature (222)..(222): n is a, c, g, or t
  modified_base (244)..(244): a, c, t, g, unknown or other
  misc_feature (244)..(244): n is a, c, g, or t
  modified_base (354)..(354): a, c, t, g, unknown or other
  misc_feature (354)..(354): n is a, c, g, or t
  modified_base (381)..(381): a, c, t, g, unknown or other
  misc_feature (381)..(381): n is a, c, g, or t
  modified_base (503)..(503): a, c, t, g, unknown or other
  misc_feature (503)..(503): n is a, c, g, or t
  modified_base (527)..(527): a, c, t, g, unknown or other
  misc_feature (527)..(527): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctcttcttggtggcagcagccacaggagcccactcccaggtgcagctggtgcaggtccggatgaggtgaagagcgtgggcctnagtgagtctctgcaggtctcgnggactcaccctcacgtacgtctatatgctacgttggtcgacgacgacggccccgtaggaccgaagggtcttaggaggtaggagttgggataggactacgaaacggtaacnggtacgtcctacgaaaactaaattcgngactaagtagtagttacggagggtcacgggtacaacgtagtcggaaccgagggaacctacggaccataacaactacacgcctaaggtacgtaggaacctgaacgccgtagacgtagagtaancgtagaccgaacgacgttacggtnttaagttagtgttacgttgaggtaactaagtcgttaagtcctttagttaaccgttaagtttaagggg

SEQ ID NO: 351149 - DNA, 520 bp, Homo sapiens
  misc_feature: GZ8MTXP01D6HA4.39.87.H10.1.454.CMB.2.raw
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (418)..(418): a, c, t, g, unknown or other
  misc_feature (418)..(418): n is a, c, g, or t
  modified_base (439)..(439): a, c, t, g, unknown or other
  misc_feature (439)..(439): n is a, c, g, or t
  modified_base (485)..(485): a, c, t, g, unknown or other
  misc_feature (485)..(485): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagcctggggcctcagtgaggtctcctgcaaggcttctggaatcacccctcaccgacgtctatatgcactggttgcgacacggcccctggacaagggcttgagtggatgggatggatcgaaacggtacaggtggtctacaaacaaattntgcaacngtaaagtttcgagggcagggtcacatgaccgaggacacgtccatcaatacancctagactggaacctgagccnggcagagtatctagcgaacgacggttccgtgttagtagttgttggngagaagagtgacgtcttcgttccttaagtttaagg

SEQ ID NO: 351150 - DNA, 593 bp, Homo sapiens
  misc_feature: GZ8MTXP01AE05Q.39.87.H10.1.454.CMB.2.raw
  modified_base (361)..(361): a, c, t, g, unknown or other
  misc_feature (361)..(361): n is a, c, g, or t
  modified_base (429)..(429): a, c, t, g, unknown or other
  misc_feature (429)..(429): n is a, c, g, or t
  modified_base (538)..(538): a, c, t, g, unknown or other
  misc_feature (538)..(538): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtagaagaagccgtgggggcctcgagtgaaggtctcctgcaaggtcttctggaactcaccctcaccgacgtctagtatgcacgtggttgcgacgacggcccccgtggacgaagggctttggagtggagtgggatggatacgaaaccggtaacngtggtctacaaactaaattgtgacacagtaagtttcgagggcagggtcaccagtacggaccaggaacncgtacagtacaagtaccagtaccctagaagtacggaacgtgagtaccgaggtccgtagaggtacttcgaggccggaacgtaccgggttccgttagttaagttagttggnggcgaggtaagtagtggtaacggtcttacgttaacccgttaacgttttaaggggg

SEQ ID NO: 351151 - DNA, 593 bp, Homo sapiens
  misc_feature: GZ8MTXP01A1N65.39.87.H10.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (259)..(260): a, c, t, g, unknown or other
  misc_feature (259)..(260): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggacaattaaaacngtatttagcctgtannagacagaaacagggaaactcctaaggtcctgatctatgatcgcctccgtagtttaggaaacggtgggggtacccatacgaaggttccaggcggnagtggaatcgtgggacaatactttcactcncaacccaanaccgacacgtccgtgaccgtactagaacttatttacaccttaattacttacgtagtaaactaaacttaattttaacttccttaccgtccgtccttaccgttacgttcggggaccgggtaacggaacgtaaagggtagaacgtaaacttaaacgaaaacgacgttggttcggctcgcaactactcgttcgttcttcgtaac

SEQ ID NO: 351152 - DNA, 827 bp, Homo sapiens
  misc_feature: GZ8MTXP01BRDEG.39.87.H10.1.454.CMB.2.raw
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
  modified_base (285)..(285): a, c, t, g, unknown or other
  misc_feature (285)..(285): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccggactgagtgaagagcgtgggcctnagtgagtctctgcaggcttgnggaactccaccctcaccgacgtctatagtgctacgtcgggttnaccggacgaccgggtcccccgtgggaaccgtaagggggtcctttaggggacggttagggtagttacgggggtattacggggtaacgtacccggtaaaacgggtaaacccgtaggggttacggggttacccgtaacctaaaccgttaaaaaaaagttttacgtcggaaaccctaaacgggtaaacgggtttaaacggttttaccggggaacggggtaccgggtaacggggttaacccaacgtaacgtacgggaacccggaaacggggtaacccgtaacccggttaacaactaaccgtaaacgttaacccgaacgtaaccgttaaaccgtaaggggttaaacggggtaaacgttaacgggaaacgttaccggaaacgggtccgttaggaaacgtacgttacccgggtacggaaaccggaaccggttaaccgggtaaccggtttagtttaacgttaggttcggtacggacggagttaacgggtaagttacggttaactttacccgttacgtttaccgttaacgggtttaaacgggttttgggggg

SEQ ID NO: 351153 - DNA, 669 bp, Homo sapiens
  misc_feature: GZ8MTXP01EKLBF.39.87.H10.1.454.CMB.2.raw
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (612)..(612): a, c, t, g, unknown or other
  misc_feature (612)..(612): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcgagtccgggactgaggtgaagagccgtgggcctcagtgagtctctgnagtcttcgngaactcaccctcaccgacgtctatagtgcacgtggtcgacgacgaccggcccctaggaaccgaagggtcttaggaggtgggagtaggggattggaactaacggtaaacggtaaccctaggttcggtactaacgtaaactaaaaattgtcggactaaacgtaagtaacggttttcggaagggggtactaacggggtacccacgtaagtaccggaaccgaacggggtacctaaccggttacccgtaataacgtaaaccttaccgaacggttaccctaagtaacggggtaggtaaacctggaacgaccgaggaccttaggacgtacgtcgtacgaccgaacggaacgggttcttaagttagttagtggngacggttagagtaagtacgtaacttacgttcttacgttaacgttggtttaacggggg

SEQ ID NO: 351154 - DNA, 567 bp, Homo sapiens
  misc_feature: GZ8MTXP01ANOHJ.39.87.H10.1.454.CMB.2.raw
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
  modified_base (523)..(523): a, c, t, g, unknown or other
  misc_feature (523)..(523): n is a, c, g, or t
  modified_base (546)..(546): a, c, t, g, unknown or other
  misc_feature (546)..(546): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccggatgaggtgaagagcgtgggcctgagtgaggtctccgtgcgaaggtcttcgtaggaactccgaccctcgacccgtacgtctatagtcgactacgtggttcgccgacgacggcccctaggacgaaggtcttggagtggagtggangatacgaacgtangtgtctacgaaactaatntcgacactagtaacgttcgagggtacgaggtacaaccgtagacggaccgagggaccacgtacaatacgaatacgacacctagagtacgtaacagaacgcgagctaggatacgtacacggaacgaacgacggttcgtagttattagtggngccgagtaagagtcgtaacgttnttacgttaagttaaggttaag

SEQ ID NO: 351155 - DNA, 791 bp, Homo sapiens
  misc_feature: GZ8MTXP01BFJY5.39.87.H10.1.454.CMB.2.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtagganacagagtcaccatcacttggaccggnaagtcagggactaattaaaatgtatttacgctaggtactacgagacaacgaaaaccgaagggaaaacctaccgtaaggtacctagtactacgtatcgtaatcgaccttaccgtaaggtttacgggaaacggttcgggggtaccccaagtaccgtaaggttacccgaggtacgggtacgtacggttggaaacttacggtcgggggaacctaaagggttacctttaccgtaccttaccttaccaaacccctacgttacccaaacccgttacgggccctacgggtcccggtaacccgttaggtaaacggtttactttttacggaaaccctttaaaccggttttaatttaccctaacgggtttaaacttaaaacgtttaaactttttaaaccggtttcttaaaccgtcccgttaaccgttaccgttaaccggtttacggggacccggtaaacggggacccgttaaaaggggcgttaaacggtaacttaaaccggaaaacggttacttcgggttcgttacgttaacgacccgtaaccctaatttcccggttacgtttccgttaacccttaaccg

SEQ ID NO: 351156 - DNA, 719 bp, Homo sapiens
  misc_feature: GZ8MTXP01EKTUX.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggatggaggtgaagagccgtgggcctgagtgaggtctccgtgcaaggtcttcgtggaactccaccctcgaccgacgtctatatggctacgtggtcgcgaacgccggccccgtaggaacagggtcttggagtggacgtggggattcgggacacgtaaacccggtatggtacggtctacgaaaaactaaagttaagtcggaacccaaaggtaaggttaaacggtttcgggacggggtaccgtaacggggtccaaccgtagtacgggaacccgaaggggaaacctaaccggtactactaaccaaaggtaccaaacgttccttaaaccggaacgttaaggggaaaccttacggaagaccgaacggttacgtacggtaaggtaaccttccggtaggtaacccggaaaccgggtccgggttaaccggttacgtttagtttaaacgtttgggaccggttcgaaagggttaagaacgtttaagggtaacttacgtttcctttaacccggtttaacgttttaaggggg

SEQ ID NO: 351157 - DNA, 715 bp, Homo sapiens
  misc_feature: GZ8MTXP01BKJSP.39.87.H10.1.454.CMB.2.raw
  modified_base (278)..(278): a, c, t, g, unknown or other
  misc_feature (278)..(278): n is a, c, g, or t
  modified_base (380)..(380): a, c, t, g, unknown or other
  misc_feature (380)..(380): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcgagtgaggtctccgtgcaaggtcttctggaactccaccctcaccgacgtntactatgcagtggttgaccgtacgaccggccccgtagggacgaacgggtctaggacgtgggtagagggtatggataccgaaacggtacaggtggtacccaanaaaactaaagtttgacgacacgtaagttaacggtttcgagggctaacgggcaaccagtacgaaaccgacgggaacctaccggttacaacgttaccaaaacgtacccgtaacggtaccccttaacgggaagttaacggggaaccttagggaaacccgtccggaaaggttcggtaaccggaagtaccgttacccgttaagggaacccggtcggaaaccgggttccggtttaggtttaaactttaagggtttccgggacggacggttaagggttaacgggatttaaccggttacggtttacccttaccgttttaaaccgttaagggttttaaccgggg

SEQ ID NO: 351158 - DNA, 757 bp, Homo sapiens
  misc_feature: GZ8MTXP01BSDSX.39.87.H10.1.454.CMB.2.raw
  modified_base (701)..(701): a, c, t, g, unknown or other
  misc_feature (701)..(701): n is a, c, g, or t
tcagtcgcactagtcacgaccggtgctcgatttagcagtactgcgttgggtttgggggagcatcacccagcaaccacatctgtcctctagagaatcccctgagagcctccgttcctcaccatggactggacctggaggatcctcttcttggtggcagcagccacaggagcccactcccaggtgcagctggtgcaggtccgggactggaggtagaagaagccgtggggcctcgagtgaaggtctccgtgacaaggtcttcgaggaactccgacccctcaaccccgacgttcctaatacgtcgtacgtcggttaggtcgaaccgaccgggaccccgtaccggtacggaaacggacggttcggtaggtagggttaggtagggtaggtaggacggtacgtaaaccggtaaaaccggaacggttaggtcgtacccgtaaactaaaaaaacgttaaagttcgacggtaaccgtaaacggtaagggtttaacgtttacgggggaacggtacgggtaaccgggttaaccaccgtaggtacccgggaaaccgggacccggtaaacccgttaaccgacctaacgttacaaaacgtaaccgacgtaacctaacgggtaggtaaacgtacgaggacggtccgaggtaacgtagaacgtacgtcgaaccgtacgggaacgtacccgggttgttaagtttagttacggtagacgnggttaacgtaatggtaactttaccggacttttccggaagttttaaccgtaaggggg

SEQ ID NO: 351159 - DNA, 618 bp, Homo sapiens
  misc_feature: GZ8MTXP01DWJZ3.39.87.H10.1.454.CMB.2.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (587)..(587): a, c, t, g, unknown or other
  misc_feature (587)..(587): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctcttctggtggcagcagccacaggacgccccactccccaggtcgcagctggtgcaggtccgggactggaggtagaagagccgtgggcctnagtgagtctcctgacaggtcttagnggaactcgaccctcaccgacgtctatatcgctagtggtcgccgacgaccgcccgtaggaacgaagggtctaggaggtggacgtagggacttgggaactacgtaaccggtacgtggttacgtctaactaaactaaattgtggaaccaaacgttaagggtaacgtttccgggagggtacgtacgggtaccacgtagtaccggacgaagggacctaccgttacacactaaacgactaacgtcccctaaggtaggttccgaaatcgggaagtccggagtgaaggtacagttcgagaccggtaacgcgggttactgttagttgtcgttgagagtaanagtcgtagtcttatccgttaagttttaaggg

SEQ ID NO: 351160 - DNA, 608 bp, Homo sapiens
  misc_feature: GZ8MTXP01BK8E7.39.87.H10.1.454.CMB.2.raw
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggacgccccactcccaggtcgcagcgtggtgcgaggtccgggactggaggtagaagacgccgtgggcctnagtgagtctcngcagctnagatcacctcacgacgtctatatgctacgtggttcgacgacgacggtccccgtaggaacgaagggtcttaggacggtggtagtggataggactacgaaaccgtanaggtacgtctacgaaactaaattcgngaacaacgtagtaacgttcgagggtacgtagggtaccacgagtacggaaccgaaggtaccacgtacaacgtacaaactacacgtaccctaaggacgtaggtaaccgtagggacgcgacggtcgtaacgacggttacacgtacggacgaacgtcggttacgttattacgtttagaggcgttaggagtaagtgtaacggtattacgttcttaacgttaagtttaaggg

SEQ ID NO: 351161 - DNA, 515 bp, Homo sapiens
  misc_feature: GZ8MTXP02GO3DO.39.87.H10.1.454.CMB.2.raw
  modified_base (450)..(450): a, c, t, g, unknown or other
  misc_feature (450)..(450): n is a, c, g, or t
tcagtcgcactagtcacgaccggtgctcgatttagcagtactgcgttgggtttgggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcacccgacgtctatatgcactggttgcgacaggcccctggacaagggcttgagtggatgggatggatcaaacggtaacagtggtctcacaaaattatgcacagaaagtttcagggcagggtcaccatagaccagggacacgtccatcaaatacagctacatggaactgagcgagcgagaggacgcagaacganacggacgtagtatagtagtagacgacgagagtaagtacgtacgtactactactacgtaggtacgg

SEQ ID NO: 351162 - DNA, 576 bp, Homo sapiens
  misc_feature: GZ8MTXP02F8RUB.39.87.H10.1.454.CMB.2.raw
  modified_base (351)..(351): a, c, t, g, unknown or other
  misc_feature (351)..(351): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgattagcctggtatcagcaagaaaccaagggaaaactctaaggtcctgatctatgatgcctcaggtttggaaagtgggtccatccaaggttcagcggcaggtggntcgtgggacagtattcactctcaccatcacagctgcggctagagtatttgactaacttattactgtactaaactaatttaacttcttaactccgtacttcctaacgttttcgggacgggtaacgggtacccgtaaaggggttacggaaagtaacgttaaccgaaaaacggtaccgttaggtaacgggtaccttacggaccaacccgtagttaccttagtttaccc

SEQ ID NO: 351163 - DNA, 500 bp, Homo sapiens
  misc_feature: GZ8MTXP02IYVBY.39.87.H10.1.454.CMB.2.raw
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaacgtacagtgtctnacaaattntgcacagaagtttcagggcagggtcacatgacaggacacgtcatcaatacagactacatagacagagcgaggagagagagtacgtagacgacgacgacgtacgtattatgtacgagagaagagtagtacgtactacttacttacgtag

SEQ ID NO: 351164 - DNA, 548 bp, Homo sapiens
  misc_feature: GZ8MTXP02GNAQV.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgatttagctggtatcagcagaaaccagggaaaactcctaaaggtcctgatctatgatgcctcagtttggaaagtgggtccatcaaggttcagcgcagtggatctgggacagattctactctcaccactctaccagcctcgcggcctcgaagtaatttgtacaactttaatttactagttactaaactaaactttaatttacttacgttacctcttctacgtttacggtcgggtaacgggaccgtaacggtaggtagaacgtacaaacgtaaacgtacgtggactgcaactactctcgttacttctac

SEQ ID NO: 351165 - DNA, 488 bp, Homo sapiens
  misc_feature: GZ8MTXP02GJ95R.39.87.H10.1.454.CMB.2.raw
  modified_base (352)..(352): a, c, t, g, unknown or other
  misc_feature (352)..(352): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtgacagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaacggtacagtgtctcacaaattntgcacagaagtttcagggcagggtcaccatgaccagggacacgtcatcaatacagcctacatgaactgagcaggctgagatctgacgacacggccgtgtattatgtgcgagaagatgacgtactcttactacttag

SEQ ID NO: 351166 - DNA, 507 bp, Homo sapiens
  misc_feature: GZ8MTXP02JSZUH.39.87.H10.1.454.CMB.2.raw
  modified_base (488)..(488): a, c, t, g, unknown or other
  misc_feature (488)..(488): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcattaaaatgattagctggtatcagcagaaaccaggaaaactctaaaggtcctgatctatgatgctcagtttggaagtgggtccatcaaggtccagcgcagtggatctgggacagatttcactctcaccatcaccagcctgcggcctgaagattttgactaacttatactagtactaaactaatttaaattcttaagtccgtcttcgactttcggcggtaggaccctaaaggtggagatcaaaacgtactcgtaggcncgacacatctcgtctctac

SEQ ID NO: 351167 - DNA, 508 bp, Homo sapiens
  misc_feature: GZ8MTXP02IX3YV.39.87.H10.1.454.CMB.2.raw
  modified_base (352)..(352): a, c, t, g, unknown or other
  misc_feature (352)..(352): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaaacggtacagtgtctcacaaattangcacagtaagtttcagggcagggtcaccatgaccagggacacgtcatcaatacagctacatggaactgacgngagtcgngagnctgacganacgcgtagtatagttgacgcgagagagtaagtacgtacgtacttactacgtacgttacggtacgg

SEQ ID NO: 351168 - DNA, 528 bp, Homo sapiens
  misc_feature: GZ8MTXP02JUVNO.39.87.H10.1.454.CMB.2.raw
  modified_base (342)..(342): a, c, t, g, unknown or other
  misc_feature (342)..(342): n is a, c, g, or t
  modified_base (508)..(508): a, c, t, g, unknown or other
  misc_feature (508)..(508): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggccccctggacaagggcttggagtgggatgggatggatcgaacggtaaccnggtggtctacacaaattatgacaacagtaagttcgagggcagggtcaccatcgacagggacacgtccaatacaatacacgacctaacagtaggaactgagacgaggctagagatctagacgacgaccggcgtgtattataggtgacgagagaagtagagttacctnttacctacgttagttcgggg

SEQ ID NO: 351169 - DNA, 492 bp, Homo sapiens
  misc_feature: GZ8MTXP02GZSDB.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaaggcttgagtggatgggatggatcaacggtaaccagtggtctcacaaattatgcacagaagtttcagggtcagggtcacatgacagggacacgtccatcaatacagcctacatggaactgagcaggctgagatctgacgacacggccgtgtattattgtgcgagagaatgagtactcttctactattggg

SEQ ID NO: 351170 - DNA, 513 bp, Homo sapiens
  misc_feature: GZ8MTXP02IUXXX.39.87.H10.1.454.CMB.2.raw
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (441)..(441): a, c, t, g, unknown or other
  misc_feature (441)..(441): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgattagctggtatcagcaagaaaccagggaaaactctaaggtcctgatctatgatgcctcagtttggaaagtggggtaccatccaagttcagcgcagtggntcgtgggacagtnttcactctcacatcacagcctgccggctagaagatttgactaaacttattactgtactaactaatttaattcttacgtccncttctacgtttcgggcggtaagggaccaaagggtcggagaatacgaaaacgactggtgctgacacatctatc

SEQ ID NO: 351171 - DNA, 506 bp, Homo sapiens
  misc_feature: GZ8MTXP02IGYNM.39.87.H10.1.454.CMB.2.raw
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccgggcaagtcaggcaattaaaatgatttagctggtatcagcagaaaccaggaaaactcctaaggtcctgatctatgatgcctcagtttggaaagtgggtaccatcgaagttcagcgcagtgatctgggacagatttcactctcaccatcacagcctagcgctgaagttnttnactattatactatactaattaatttatctactctatctacgttcggacgtaggacgtaaggtgataactaacgaaacgtacgtagtcgactaacgacactactcgtcttctactac

SEQ ID NO: 351172 - DNA, 546 bp, Homo sapiens
  misc_feature: GZ8MTXP02J2L5M.39.87.H10.1.454.CMB.2.raw
  modified_base (483)..(483): a, c, t, g, unknown or other
  misc_feature (483)..(483): n is a, c, g, or t
  modified_base (525)..(525): a, c, t, g, unknown or other
  misc_feature (525)..(525): n is a, c, g, or t
  modified_base (527)..(546): a, c, t, g, unknown or other
  misc_feature (527)..(546): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcgagtccggactggaggtgaagacgccgtcgggcccagtgaggtctcctgcaggtcttcgagactccaccctcgaccgacgtctatatgctacgtggtcgccgacgaccggccccgtaggacgaggtcttaggaggtggagtgggataggaacgtacgaaacggtactacggtcgtactacaaactaatagtacgacagtaaggtacgtacgacggtacgtacggtcaacgagtcgaacccgaaggtaccacgtacaatacaaactaccgacgtactaacgaggtacggaacgnggacgggacgggtacgacggaacggaaccgggcgacgagagngnnnnnnnnnnnnnnnnnnnn

SEQ ID NO: 351173 - DNA, 519 bp, Homo sapiens
  misc_feature: GZ8MTXP02IB0M9.39.87.H10.1.454.CMB.2.raw
  modified_base (354)..(354): a, c, t, g, unknown or other
  misc_feature (354)..(354): n is a, c, g, or t
  modified_base (413)..(413): a, c, t, g, unknown or other
  misc_feature (413)..(413): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggccccctggacaagggctgagtggatgggatggatcgaaacggtaacagtggtctcacaaattangcacagaagtttcagggtcagggtcacatgaccagggacacgtcatcaatacagcctanataggaactgagcgagctgagatctagacgacacggcgtagtattattgtgacgtagagagtaaggtagtacttcgttactacgttagtttacgggtttacggggg

SEQ ID NO: 351174 - DNA, 552 bp, Homo sapiens
  misc_feature: GZ8MTXP02F756X.39.87.H10.1.454.CMB.2.raw
  modified_base (328)..(328): a, c, t, g, unknown or other
  misc_feature (328)..(328): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcaattaaaatgatttagcctggtatcagcagaaaccaggaaactcctaaggtcctgatctatgatgcctcagttggaagtgggtccatcagtcagcgnagtgatcgtgggacagtatttcactctcacatcaccagcctgcgctgaatatttgactaacttattactgtactaaactaattttaacttcttaacgtccgtcttaccgtaacgtttcgggaccggtaaggggtaaccctaaaaggggttcggaaagtaacttaaccgaaaacgtaaccgttggtggacttggaccaaccgtatccttagtcctttactaaccg

SEQ ID NO: 351175 - DNA, 525 bp, Homo sapiens
  misc_feature: GZ8MTXP02HTH28.39.87.H10.1.454.CMB.2.raw
  modified_base (332)..(332): a, c, t, g, unknown or other
  misc_feature (332)..(332): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagcctggtatcagcagaaaccaggaaaactctaaggtcctgatctatgatgcctcagtttggaaagtgggtccatcaagttcagcgnagtgatctgggacagatttcactctcacatcaccagcctgcgctgaagtatttgactaacttattactgtactaaataatttaattcttaatcccgtacttctaacgtttcgggacgggtacgggtaaccaaagggtggaagtaactacgaaaacgaactcggtggctaagcaacctatccttgtcctttcac

SEQ ID NO: 351176 - DNA, 736 bp, Homo sapiens
  misc_feature: GZ8MTXP02JKZHJ.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcaattaaaatgattagctggtatcagcaagaaaccaggtaaactccgtaaggtcctagatctatgatcgccttaccgaggttttacgggaaaacggttcggggtacccctaagttaccgtaaagggtttacccgacggaccgggacgtaagggttcgggtaacgttcggtagggggtaaacctaaggttaactttttacccaaccttcccttaccaaccctaacttacccaaaccccgtagtcccccgttagggcccgggtacccttagggtaaacgttacgtttttacgacctttaaaacgttttaattaaccgttacgttaaccttaaaacctttaaatttttaactttaccttaacgttacccgtcctttaccgtaaccggttttaccggggacgggtaacggggtaacccgtaaaggggttcggaaacgtaacgttaaccgaaaacggtaacgttggacggtctaacgacctactacgttcctacgttaccttactaacccg

SEQ ID NO: 351177 - DNA, 498 bp, Homo sapiens
  misc_feature: GZ8MTXP02I7YQ5.39.87.H10.1.454.CMB.2.raw
  modified_base (427)..(427): a, c, t, g, unknown or other
  misc_feature (427)..(427): n is a, c, g, or t
  modified_base (461)..(461): a, c, t, g, unknown or other
  misc_feature (461)..(461): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgatttagcctggtatcagcaagaaaccaggaaaactcctaaaggtcctagatcatgatgctcagtttggaaagtgggtccatcaggttccagcgcagtgatcgtgggacagtattcactctcacatcacagcctgcggcctgaagtatttgactaacttatactgtacaactaatttaatcttaanccgtactcactttcggcgtaggaccaaggtgaanactacaaacgactagtgctgacacatctagtctctac

SEQ ID NO: 351178 - DNA, 567 bp, Homo sapiens
  misc_feature: GZ8MTXP02J2CJD.39.87.H10.1.454.CMB.2.raw
  modified_base (407)..(407): a, c, t, g, unknown or other
  misc_feature (407)..(407): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggctaattaaaatgatttagcctggtatcagcaagaaaccaggaaaactcctaaggtcctgatctatgatcgcctccgagtttggaaagtcgggtaccatcgaaggttccagcggcaggtggatcgtggggacagtattcactctacaccatccaccagcctgccggctagaacgttntttcgactaacttattactgtactaacttaagtttattcttatccgtactacgtacgtttcgggacgggaagggaaccgtaagggtaggagaaacgtaccaaaacggtacgtggtacggtctaacggacctaaccgtattccgtacgttacctttctacc

SEQ ID NO: 351179 - DNA, 495 bp, Homo sapiens
  misc_feature: GZ8MTXP02IOGJV.39.87.H10.1.454.CMB.2.raw
  modified_base (381)..(381): a, c, t, g, unknown or other
  misc_feature (381)..(381): n is a, c, g, or t
  modified_base (470)..(470): a, c, t, g, unknown or other
  misc_feature (470)..(470): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcattaaaatgattagctggtatcagcagaaaccagggaaactcctaaggtcctgatctatgatgcctcagtttggaaagtgggtccatcaggtcagcgcagtgatctgggacagatttcactctcaccatcaccagcctgcgcctgaagtntttgactaattattactagtacaactaatttatcttatccgctctactttcggcggtaggaccaaggtgagaatacgaaacgtaactgngactgctaccatctcgtacttctac

SEQ ID NO: 351180 - DNA, 519 bp, Homo sapiens
  misc_feature: GZ8MTXP02INTCN.39.87.H10.1.454.CMB.2.raw
  modified_base (394)..(394): a, c, t, g, unknown or other
  misc_feature (394)..(394): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgatttagctggtatcagcagaaaccagggaaactcctaaaggtcctgatctatgatgcctccagtttggaaagtcgggtaccatcaaggttcagcggcagtggatcgtggggacagtatttcactctcaccatcaccagcctgcgctgaagtntttgactaattattactgtactaactaatttattacttactccgtcttctacgtttcggacggagggacctaagggtggagactacaaacgtactacgtggctgcacgtactctcgtcttactac

SEQ ID NO: 351181 - DNA, 513 bp, Homo sapiens
  misc_feature: GZ8MTXP02JIXQ7.39.87.H10.1.454.CMB.2.raw
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
  modified_base (482)..(482): a, c, t, g, unknown or other
  misc_feature (482)..(482): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacagggcttgagtggatgggatggatcagcgcttacaagtggtacaacacaaactngacaacagaacctcgagggcagagtcacatgaccanagacacactaccacgacgactacggacctacagtcggacctgaggcgccgtagacgactcgtagacgacgacggtcgtacgtacttacgngtgcgagacgagtacgggaaattagtttacg

SEQ ID NO: 351182 - DNA, 501 bp, Homo sapiens
  misc_feature: GZ8MTXP02FYOZV.39.87.H10.1.454.CMB.2.raw
  modified_base (490)..(490): a, c, t, g, unknown or other
  misc_feature (490)..(490): n is a, c, g, or t
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaacggtaaccagtggtctacacaaattatgcacagtaagtttcgagggcagggtcaccatgacaggacacgtccatcaatacagacctacataggaactgacgcgacgtgagagacgcgtagacgacacgcgtagtactatgtcgacgagagaatgagtactntactactagtg

SEQ ID NO: 351183 - DNA, 509 bp, Homo sapiens
  misc_feature: GZ8MTXP02G6K2V.39.87.H10.1.454.CMB.2.raw
  modified_base (359)..(359): a, c, t, g, unknown or other
  misc_feature (359)..(359): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaaccggtacagtggtctacgaacaaattntgacacgagtaagtttcgagggcgagggtcaccgatgaccgagggacacgtccatacaatacagcctacatagactgagcgagcgtgagatacgtagacgacgacgcgtagtagttatgtcgngagaaganagagtactctactagttag

SEQ ID NO: 351184 - DNA, 523 bp, Homo sapiens
  misc_feature: GZ8MTXP02IKHAT.39.87.H10.1.454.CMB.2.raw
  modified_base (329)..(329): a, c, t, g, unknown or other
  misc_feature (329)..(329): n is a, c, g, or t
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagcctggtatcagcagaaacaggaaactcctaaggtcctgatctatgatgcctcagtttggaagtgggtccatcaggtcagcgnagtgatcgtgggacagtattcactctacaccatcaccagcctgcgctgaagtntttgactaactttattactntactaaacttaattttattcttactccgtacttctacgtttcggacggtagggaacctaagggtggaagtactaacaaaacggtctagtcgactgacctacgtatcctacgttcttactac

SEQ ID NO: 351185 - DNA, 543 bp, Homo sapiens
  misc_feature: GZ8MTXP02IE0AX.39.87.H10.1.454.CMB.2.raw
  modified_base (197)..(197): a, c, t, g, unknown or other
  misc_feature (197)..(197): n is a, c, g, or t
  modified_base (338)..(338): a, c, t, g, unknown or other
  misc_feature (338)..(338): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccgggcaagtcaggcaattaaaatgatttagctggtatcagacagaaaccaggaaaactctaaggtcctgatctatgatgcctctagtttaggaaagtggggtacccatcgagttccagcgnagtgatcgtggggacagtctttcactctacaccatcaccagccngcgctgaatntttgactaattattactgtactaaactaattttacttcttaatccgtattcctacgtttcgggacggtaacgggaacctaaggggtagaagtactacgaaaacggtacttggtcgcgtaacgcctaacctatccgttacgttctttactac

SEQ ID NO: 351186 - DNA, 534 bp, Homo sapiens
  misc_feature: GZ8MTXP02I6OZI.39.87.H10.1.454.CMB.2.raw
  modified_base (356)..(356): a, c, t, g, unknown or other
  misc_feature (356)..(356): n is a, c, g, or t
  modified_base (508)..(508): a, c, t, g, unknown or other
  misc_feature (508)..(508): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaacggtacagtggtctcaacaaattntgacacagtaagtttcaggggacaggggtcacccgatcgaccgaggacacggtaccagtacaaatacacgacctacattaggaactggaacgcgaaggtcaggaagctcgtagaccgacgacggcctaggtattacgtgtacgacgagaagngtaggactacttcttactacgttagg

SEQ ID NO: 351187 - DNA, 505 bp, Homo sapiens
  misc_feature: GZ8MTXP02F823Z.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctcagttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatccgaacggtacagtggtctacacaattatgcacagtaagtttcgagggcagggtcaccgatgaccagggacacgtccatcaatacagcctacatggaactgagcgaggctagagatcgtagacgacgacggccgtagtacttacgttgtgacgaagagatgagtactcttcttaacg

SEQ ID NO: 351188 - DNA, 510 bp, Homo sapiens
  misc_feature: GZ8MTXP02GCQT2.39.87.H10.1.454.CMB.2.raw
  modified_base (355)..(355): a, c, t, g, unknown or other
  misc_feature (355)..(355): n is a, c, g, or t
  modified_base (417)..(417): a, c, t, g, unknown or other
  misc_feature (417)..(417): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaacggtaacagtggtctcacaaattntgacacagaagtttcgagggcagggtcacatgaccagggacacgtcatcaatacagcctaanagtagaactagagcgaggctgagatcgtagacgacgacggtacgtgtattagtcgtagcgagaagtataggacgtactacttactactttagg

SEQ ID NO: 351189 - DNA, 527 bp, Homo sapiens
  misc_feature: GZ8MTXP02GWSG9.39.87.H10.1.454.CMB.2.raw
  modified_base (286)..(286): a, c, t, g, unknown or other
  misc_feature (286)..(286): n is a, c, g, or t
  modified_base (338)..(338): a, c, t, g, unknown or other
  misc_feature (338)..(338): n is a, c, g, or t
  modified_base (355)..(355): a, c, t, g, unknown or other
  misc_feature (355)..(355): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttncgacaggcccctggacagggcttgagtggatgggatggatcgaacggtaacngtggtctcaacaaattntgacactagaagtttcgagggtcagggtacaaccatcggacgagggacacgtacatacaatacacgcctaacagtagggaactggacgacgaggctagaacgtatacgtagacgacgacgggccgtgtattactgtcgcgagtaagagtagacgtactacttctaacgttgg

SEQ ID NO: 351190 - DNA, 506 bp, Homo sapiens
  misc_feature: GZ8MTXP02JX6JL.39.87.H10.1.454.CMB.2.raw
  modified_base (354)..(354): a, c, t, g, unknown or other
  misc_feature (354)..(354): n is a, c, g, or t
  modified_base (433)..(433): a, c, t, g, unknown or other
  misc_feature (433)..(433): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaaggcttgagtggatgggatggatcgaaccggtacagtggtctcacaattntgcacagaagtttcgagggcagggtcaccatcgaccagggacacggtccatcaatacagcctacatagactggagcggngacggacgaaggcgcagtaacggacgacgctagtatatacgacgagagaagacgacgacgtatactactactg

SEQ ID NO: 351191 - DNA, 491 bp, Homo sapiens
  misc_feature: GZ8MTXP02FPH6Q.39.87.H10.1.454.CMB.2.raw
  modified_base (332)..(332): a, c, t, g, unknown or other
  misc_feature (332)..(332): n is a, c, g, or t
  modified_base (384)..(384): a, c, t, g, unknown or other
  misc_feature (384)..(384): n is a, c, g, or t
  modified_base (470)..(470): a, c, t, g, unknown or other
  misc_feature (470)..(470): n is a, c, g, or t
tcagtcgcactagtcacgaccggtgctcgatttagcagtactgcgttgggtttggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgatttagcctggtatcagcagaaaccagggaaaactctaaggtcctgatctatgatgcctcagttgaaagtgggtccatcaaggttcagcgnagtggatctgggacagatttcactctcaccatcaccagcctgcgcctgaagnttttgcaacttattactgtacaactaatttaatcttaatccgctctactttcggcgtagggaccaaggtgagatcgaaacgactgngactgcaccatctgtctctac

SEQ ID NO: 351192 - DNA, 582 bp, Homo sapiens
  misc_feature: GZ8MTXP02HR33L.39.87.H10.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccggnaagtcagggcattaaaatgtattagctgtatcagcaagaaaccaggaaaactccgtaaaggtcctagatctatgatcgcctacgtaggtttaggaaaggtcggggtaccagtccgaaggttcaggcggactaggtggatcgtagggactagtactttcacttctacacctactccaccgacgtcccgtagccggtctagtaacgttatttcgaacttaaacctttattaaccgttgtaaccttaaacttaattttaaacttcttaactccgacttctacgttcgggacggaacggtacgtaaggtcggaaagtactacgaaaaccgtgtgcgactacgacactacgtctcgtttacc

SEQ ID NO: 351193 - DNA, 548 bp, Homo sapiens
  misc_feature: GZ8MTXP02IBNTK.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcaattaaaatgattagctggatcagcaagaaacaggaaactctaaggtcctgatctatgatcgcctacgaggtttaggaaagtcgggtaccagtcgaaggttccagcgcaggtggatcgtggacagtatttcactcacaccatcacagcctgcgtctagaagtattgctaacttattactagtactaaacttaattttaactacttactccgtcttacgtacgtttcggacgggtaagggtacctaagggtcgagtaaacttaccgaaaacgtacgtggtagacgtaacgactactactccttacgtctttactaccg

SEQ ID NO: 351194 - DNA, 540 bp, Homo sapiens
  misc_feature: GZ8MTXP02JH2DY.39.87.H10.1.454.CMB.2.raw
  modified_base (222)..(222): a, c, t, g, unknown or other
  misc_feature (222)..(222): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcaattaaaatgatttagcctggtatcagcaagaaaccagggaaactcctaaggtcctgatctatgatcgcctcagtttggaaagtgggtacccatcgaaggttccagcggacaggtggatcgtggggacagtatttcactctcaccatcaccacgcctgccgctagaacgtatttgactaacttatactagtacaacttaatttacttcttactccgcttacgacgtttcgggacggtaggaccaagggtcggaagtactacgaaacgtacgtggtcggctgactaccgatcctacgttccttataccg

SEQ ID NO: 351195 - DNA, 523 bp, Homo sapiens
  misc_feature: GZ8MTXP02HAVSU.39.87.H10.1.454.CMB.2.raw
  modified_base (353)..(353): a, c, t, g, unknown or other
  misc_feature (353)..(353): n is a, c, g, or t
tcagtcgcactagtcacgaccggtgctcgatttagcagtactgcgttgggtttgggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaaacggtacagtggtctcaactaaattngcaacagtaagtttcaggggtacaggggtcaaccagtacgacgagggacacgtaccatacaatacacgacctacatggaacttgagacgaggctagagactcgtagacgacgacggccgtagtattagtgtagcgtagagagtgagtactcttactactagtggttaggg

SEQ ID NO: 351196 - DNA, 506 bp, Homo sapiens
  misc_feature: GZ8MTXP02HRG9H.39.87.H10.1.454.CMB.2.raw
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (478)..(478): a, c, t, g, unknown or other
  misc_feature (478)..(478): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaaggcttgagtggatggatggatcgaacggtaccagtgtctcacaaattatgcacagaagtttcaggggacagggtcaccatgacgagggacacgtaccatcaatacacgacctacataggaactgagcaggctagagntcngacgacacggcgtagtattattgtcgacgtagagngtgaacgtctcgttctactagtttgggg

SEQ ID NO: 351197 - DNA, 508 bp, Homo sapiens
  misc_feature: GZ8MTXP02FVE2L.39.87.H10.1.454.CMB.2.raw
tcagtcgcactagtcacgaccggtgctcgatttagcagtactgcgttgggtttgggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggctgagtggatgggatggatcgaaacggtacagtggtctcaacaaattatgcacagaagtttcagggcagggtcacatgacagggacacgtcatcaatacagcctacataggaactgagcggagtcgagaagacgtcagacgacacgcgtgtatactgtacgacgagagagtaagtacgtacgtactacgtactacgtacggtagg

SEQ ID NO: 351198 - DNA, 517 bp, Homo sapiens
  misc_feature: GZ8MTXP02HIZEB.39.87.H10.1.454.CMB.2.raw
  modified_base (225)..(225): a, c, t, g, unknown or other
  misc_feature (225)..(225): n is a, c, g, or t
  modified_base (342)..(342): a, c, t, g, unknown or other
  misc_feature (342)..(342): n is a, c, g, or t
  modified_base (393)..(393): a, c, t, g, unknown or other
  misc_feature (393)..(393): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctctatcctccctgtctgcatctgtaggagacagagtcaccatcacttgccggnaagtcagggcattaaaatgattagcctgtatcagcagaaaccaggaaaactcctaaggtcctgatctatgatgcctcagtttggaaagtggggtccatccaaggttcagcgcagtgngtctagggacagtatttcactctcaccatcaccagcctgccggctagaatntttgactaaactttattactgtacaaacttaatttaacttcttatccgtctctacgtttcggacggtacggaccgtaagggtcggaagatacgaaacgactggtgctgaccacctatcttgtcc

SEQ ID NO: 351199 - DNA, 539 bp, Homo sapiens
  misc_feature: GZ8MTXP02FR5Q7.39.87.H10.1.454.CMB.2.raw
tcagtcgcactagtcacgaccggtgctcgatttagcagtactgcgttgggtttggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcattaaaatgatttagcctggtatcagcagaaaccaggaaagcccctaagctcctgatctatgctgcatccagtttgcaaagtggggtccatcaaggttcatcggcagtggatctgggacagtatttcactctcaccatcagcagcctagcagcctgaaagtattttgactaacttactattgtacaacaggtctaaacacgtttaccccgaaggaccgtttacgggacccgaaaggggtacccaaaaggggttagggaaaacttacgaaaacgtaaacgtggtacggacttcggaccacctatctttcg

SEQ ID NO: 351200 - DNA, 591 bp, Homo sapiens
  misc_feature: GZ8MTXP02GR20J.39.87.H10.1.454.CMB.2.raw
  modified_base (335)..(335): a, c, t, g, unknown or other
  misc_feature (335)..(335): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcaagaaaccagggaaaactctaaaggtcctgatctatgatgcctcagttgaaagtgggtccatcaagtccagcgnagtgatcgtgggacagtatttcactctacacatcacagcctgcgcctgaagtatttagactaacttattactagtacaaactaatttaacttacttaacgtccgtacttccgtaacgtttcgggaccgggtaaggggaacccgtaaaggggttacggaaaggaacttaaacgaaaaacccggtaacgttaacggttagggcccttaaggtacccaacccgtaaattccgtaacgtttaccctttacgttaaacccg

SEQ ID NO: 351201 - DNA, 530 bp, Homo sapiens
  misc_feature: GZ8MTXP02FRQFG.39.87.H10.1.454.CMB.2.raw
tcagtcgcactagtcacgaccggtgctcgatttagcagtactgcgttgggtttgggggagcaccacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaacggtaacagtggtctacgacaaattatgacaactaaggtaaagtttcgaggggacaggggtacacccatagaaccgagggaccacgtacccataccaatacagacctacaagtacggaactgagcgacgtcgagagatcagacgaaggcgtagtattatgtagcgagagatggtatactctatactagtggttaacggg

SEQ ID NO: 351202 - DNA, 511 bp, Homo sapiens
  misc_feature: GZ8MTXP02FKEFH.39.87.H10.1.454.CMB.2.raw
  modified_base (242)..(242): a, c, t, g, unknown or other
  misc_feature (242)..(242): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagctgggcctcagtgaggtctcctgcaggcttcngaatcaccctcaccgcgtctatatgcactggttgcgacaggcccctggacgaagggcttgagtggatgggatggatcgaaacggtaacagtggtctcaacgtaaattatgcacagtaagtttccgagggtcgagggtcaccatacgacgagggacacgtcatacaatacagcctacataggaactgagcgagcgtgaggactcgagacgcgaacggccgtagtattagtgtgcgagagatgagtactcgttctactagtggtttaaggg

SEQ ID NO: 351203 - DNA, 574 bp, Homo sapiens
  misc_feature: GZ8MTXP02I7LVN.39.87.H10.1.454.CMB.2.raw
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggnaagtcaggcaataaaangattagctgtancagcaagaaacaggaaactctaagtctagatctatgatgcctcgtagtttaggaaagtcggggtacccataccgtaaggttcaggcggcaggttggatcgtgggacagtatttcactctacaccatccacagccctgccggctagaagtatttagactaaactttattactataacctaaattaaatttaacttacttaactcccgtactacgttaccgtttacgggaccgggtaaacgggtaccgaaaggggttacgaaagtaacgtaaacgaaaacgtaacgtggtaacggactacgaccaactacttcgtcgttacc

SEQ ID NO: 351204 - DNA, 501 bp, Homo sapiens
  misc_feature: GZ8MTXP02I8QXV.39.87.H10.1.454.CMB.2.raw
  modified_base (424)..(424): a, c, t, g, unknown or other
  misc_feature (424)..(424): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagctggatcagcagaaaccaggaaaactcaaggtcctgatctatgatgcctcagtttggaaagtgggtccatcgagtccagcgcagtgatctgggacagattcatctcaacatcacagcctgcgctgaagtatttgactaaacttatactgtactaaactaaatttaatcttaagtccnttacactttcggacggagaccaaggtgaagatacgaaaacgtaactgtgactgacaaccatcctgtaccttctaacc

SEQ ID NO: 351205 - DNA, 507 bp, Homo sapiens
  misc_feature: GZ8MTXP02GUH4O.39.87.H10.1.454.CMB.2.raw
  modified_base (355)..(355): a, c, t, g, unknown or other
  misc_feature (355)..(355): n is a, c, g, or t
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (473)..(473): a, c, t, g, unknown or other
  misc_feature (473)..(473): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaaccggtacagtggtctcacaaattntgacacagaagtttcgagggcagggtcaccatcgacagggacacgtcatcaatacagcctaanatagactgagcgagtcgagagntcgagacgacgacgcgtgtattagttcgacggngagaagtagtacgtacgtactacttactacgtag

SEQ ID NO: 351206 - DNA, 581 bp, Homo sapiens
  misc_feature: GZ8MTXP02JZJRA.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacaggcccctggacaagggcttgagtggatgggatggatcgaaccggtaacagtggtactcaacaaatttgtcgacaacgagtaagtttcgaggggcagggtcacagtggccagggacacgtcagtcatacagcctacgagtacgaactggagtacgacgggtacctaggaacgtagtaccgtagtaacgtacggaaccgtaccgggtcccggttagttaacgtttagttaccggttaggaccggaaggtacggtagttaccggtaagttaccgttacgtttacctttaacgg

SEQ ID NO: 351207 - DNA, 593 bp, Homo sapiens
  misc_feature: GZ8MTXP02HKZ69.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcaattaaaatgatttagcctggtatcagcaagaaaccaggaaaactcctaaggtcctgatctatgatcgcctccgtaggtttaggaaaggttcggggtacccagtacgaaggttccaggcggcaggtggactcgtggggactagtactttccgacttctacaccatccacccagcctgccggactagaatatttcgactaactttattactagtactaaactaatttaacgttcttactccgtcttactacgtttcgggacgggtaaggaccctaaggggtacggaagacgtaaccgaaaacggtaacgttggtacggactaacggacctaacccgtagttccttacgttcctttacgtaccc

SEQ ID NO: 351208 - DNA, 545 bp, Homo sapiens
  misc_feature: GZ8MTXP02I9Q1P.39.87.H10.1.454.CMB.2.raw
  modified_base (341)..(341): a, c, t, g, unknown or other
  misc_feature (341)..(341): n is a, c, g, or t
  modified_base (385)..(385): a, c, t, g, unknown or other
  misc_feature (385)..(385): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgatttagcctggtatcagcagaaaccaggaaactcctaaggtcctgatctatgatgcctcagtttggaagtgggtccatcaaggtcagcgcagtgatcgnggggacagtattcactctcaccatcaccagcctgcgctgaagtntttgactaattagtactgtactaactaatttaattcttaactccgtacttcgtacgtttcgggacggtacggggaacctaaagggttggaagaacgttacgaaaacgtacgtaggtcggactaacggacctaacctacttcgtacgttcctttacgtacc

SEQ ID NO: 351209 - DNA, 651 bp, Homo sapiens
  misc_feature: GZ8MTXP02JGUOK.39.87.H10.1.454.CMB.2.raw
  modified_base (251)..(251): a, c, t, g, unknown or other
  misc_feature (251)..(251): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctctgcaaggctcnggaatccaccctcaccgacgtctatatgcacgtggttgcgacacggcccctggacgaaggcttggagtggagtgggatggatacgaaaccggtacaggtcgtactacaaacgtaaaattgtagacaacgaaggtaacgtttacggaaggggtcgaaggggtcaaccgagtacgaacccgaaggggaaccaccggtaccaacttacgaaaactaccgaaacgacccttaacgaagtacgggtaaacctaggaacgacggacggaccgtaggaacggtacgttacgtacggaaaccggaccggtaaccggggtcccgttaacggttaactttacgttaggtacggtacgaaggaagtacgtaggtaacggtttacttacgtttaaccgttaacgtttaacgg

SEQ ID NO: 351210 - DNA, 532 bp, Homo sapiens
  misc_feature: GZ8MTXP02I2VJ1.39.87.H10.1.454.CMB.2.raw
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttggccgggcaagtcgagggacaattaaaaatgtatttagcctggtatcagcaagaaaccagggaaaactctaaaggtcctagatctatgatgcctcagttggaagtgggtccatacaagttcagcgnagtgatgnggggacagtatttcactctcacatcacagcctgcgctagaagtatttgactaattatactagtactaacttaatttaattacttactccgtcttcgtacgtttcggacggtaggaccgtaaaggtcgaagactaacgaaaacgtacgtaggtggactcggacaactcgtctcgttcttctacc

SEQ ID NO: 351211 - DNA, 503 bp, Homo sapiens
  misc_feature: GZ8MTXP02FKOIT.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaaacggtaacagtggtctcacaaattatgcacagaagtttcaggggtcaggggtcaccatgaccagggacacgtccatcaatacagcctacataggaactgagcagctgagatcagacgacacggccgtagtattattgtgcgagagatgagtactcttactactagtggttacgggg

SEQ ID NO: 351212 - DNA, 493 bp, Homo sapiens
  misc_feature: GZ8MTXP02JQBRD.39.87.H10.1.454.CMB.2.raw
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagaagcctggggcctcagtgaaggtctcctgcaaggcttctggaatcaccctcaccgacgtctatatgcactggttgcgacaggcccctggacaagggctgagtggatgggatggatcaacggtacagtgtctnacaaattntgcacagaagtttcagggtcagggtcacgatgaccagggacacgtcatacaatacagcctaacagtaggactgagcaggctgagntacngacgacacgcgtagtattagttagcgagagaagatagactactcttactagtg

SEQ ID NO: 351213 - DNA, 560 bp, Homo sapiens
  misc_feature: GZ8MTXP02G1GD3.39.87.H10.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (407)..(407): a, c, t, g, unknown or other
  misc_feature (407)..(407): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccgggnaagtcaggacattaaaatgatttagcctggtatcagcaagaaaccagggaaaactccgtaaggtcctgatctatgatgcctcgagtttggaaagtgggtaccagtcgaaggtccagcggcaggtgatcgtggggactagtactttacactctacaccatccaccagcctggccgtctagaagttntttgactaactttattctagtactaaactaattttaacttcttaactccgtacttctacgtttcgggacggtaacgggacctaagggttaggagaacgttacgaaaaacgtcgtgtacggactggaccacctattcctacgttacttcgtacc

SEQ ID NO: 351214 - DNA, 566 bp, Homo sapiens
  misc_feature: GZ8MTXP02HAW7L.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttcgacccagtctccatccctcctgtctgcatctgtaggagacagagtcaccatcacttgccgggacaagtcgaggacaattaaaatgtattagctaggtatcagcaagaaaccgaaggaaactcgtaaggtcctagatctatgatcgcctacgtaggtttaggaaaggtcgggtacccagtacgtaaggttccgaggcggacgaggtggatcgtggggactagtactttcacttcacaccatccaccagcctgccgtactagagtatttcactaattatactgtactaaatatttattctactcctcttactacgttcgggacggtaggacctaaagggtggaagaacgtaaccgaaaacgtacgttggcgtacgtaacgacctactagttcgttcttacctactacc

SEQ ID NO: 351215 - DNA, 563 bp, Homo sapiens
  misc_feature: GZ8MTXP02FR1RP.39.87.H10.1.454.CMB.2.raw
  modified_base (336)..(336): a, c, t, g, unknown or other
  misc_feature (336)..(336): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgatttagcctggtatcagcagaaaccagggaaaactcctaaggtcctgatctatgatgcctcagtttggaaagtgggtccatcaaggttcagcgnagtggatcgtgggacagatttcactctcacatcaccagcctgcggcctgaagtattttgactaacttattactgtactaaactaatttaattcttactccgtacttctacgtttcgggacggtaacgggacctaaaggggtggaagtacgttaaccgaaaacggtaaccgtcggtacgggtacttcggaccgtaaccacgtttacctacggttcctttacgtaaccg

SEQ ID NO: 351216 - DNA, 521 bp, Homo sapiens
  misc_feature: GZ8MTXP02FOS6Q.39.87.H10.1.454.CMB.2.raw
  modified_base (445)..(445): a, c, t, g, unknown or other
  misc_feature (445)..(445): n is a, c, g, or t
  modified_base (481)..(481): a, c, t, g, unknown or other
  misc_feature (481)..(481): n is a, c, g, or t
  modified_base (498)..(498): a, c, t, g, unknown or other
  misc_feature (498)..(498): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgaatttagcctggtatcagcaagaaaccagggaaaactcctaaaggtcctgatctatgatcgcctcagtttggaaagtggggtccatcaaggttccagcgcagtgatcgtgggacagtattcactctacaccatcaaccagccctagccggctgaagtattttgactaactttattactgtacctaaataatttatacttacnccgtctctacgttcggacggtaggaccaaggtgganaatacaaaacgtactgnggctgcaaccatctattctctac

SEQ ID NO: 351217 - DNA, 512 bp, Homo sapiens
  misc_feature: GZ8MTXP02F3QDY.39.87.H10.1.454.CMB.2.raw
  modified_base (342)..(342): a, c, t, g, unknown or other
  misc_feature (342)..(342): n is a, c, g, or t
  modified_base (479)..(479): a, c, t, g, unknown or other
  misc_feature (479)..(479): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccggcaagtcagggacaattaaaatgattagctgtatcagacagaaaccaggaaaactctaaggtcctgatctatgatcgcctcgagtttaggaaagtgggtaccagtccaagtcagcggnagtgatcgtgggactagatttcactctacacatcaccagcctgcggctagaacgtatttgactaacttatactgtactaaactaatttaattcgtatccgacttcacgtttcggacggtacggaccgaaggtcgaanactacaaaacgtactgtgactgacacatctctc

SEQ ID NO: 351218 - DNA, 569 bp, Homo sapiens
  misc_feature: GZ8MTXP02G72F2.39.87.H10.1.454.CMB.2.raw
  modified_base (221)..(221): a, c, t, g, unknown or other
  misc_feature (221)..(221): n is a, c, g, or t
  modified_base (361)..(361): a, c, t, g, unknown or other
  misc_feature (361)..(361): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccgggnaagtcagggacaattaaaatgattagcctggtatcagcagaaacaggaaaactcctaaggtcctgatctatgatgcctcgaggtttaggaaaggttcggggaccctagtacgtaaggttccgaggcggcaggtggatcgngggacaggtatttcactctacaccatccaccacgcctcgcggacctagaagtatttacgactaaactttattactgtaactaaactaatttaacttcttacgttccacttacctacgtttccgggacgggaaggtaaccgtagggtagaagtaactaaaccgaaacggtaactggtggactgactacctatcttacgtcttactaccg

SEQ ID NO: 351219 - DNA, 528 bp, Homo sapiens
  misc_feature: GZ8MTXP02G2ULP.39.87.H10.1.454.CMB.2.raw
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggagtgggatggatcgaacggtaacagtgtactacaactaaattatgacacagtaagtttcgagggcagggtcacgatgacgagggacacgtccatacaaatacacgacctacagtaggaacctgacgcgaaggctaggagactcgagacgacgacggtcgtagtattagtgtacgacgagagaagtagacttactcttactacgtagttagggg

SEQ ID NO: 351220 - DNA, 493 bp, Homo sapiens
  misc_feature: GZ8MTXP02H4OY2.39.87.H10.1.454.CMB.2.raw
  modified_base (252)..(252): a, c, t, g, unknown or other
  misc_feature (252)..(252): n is a, c, g, or t
  modified_base (287)..(287): a, c, t, g, unknown or other
  misc_feature (287)..(287): n is a, c, g, or t
  modified_base (353)..(353): a, c, t, g, unknown or other
  misc_feature (353)..(353): n is a, c, g, or t
  modified_base (469)..(469): a, c, t, g, unknown or other
  misc_feature (469)..(469): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagaagcctggggcctcagtgaaggtctcctgcaaggcttcnggaatcaccctcaccgacgtctatatgcactggtncgacaggcccctggacaaggcttgagtggatgggatggatcaacggtacagtggtctcacaaattntgcacagaagttcagggcagggtcacatgacagggacacgtcatcaatacagctacatggaactgagcaggctgagatctagacgacacggccgtagtattattgtagcgagaagntagacgtactctttctaacttagg

SEQ ID NO: 351221 - DNA, 526 bp, Homo sapiens
  misc_feature: GZ8MTXP02GNUAR.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacaggcccctggacaagggcttgagtggatgggatggatcgaaacggtaacagtggtctacgaacaaattatgcacagaagtttcgaggggcaggggtcaccatgaccagggacacgtcatacaaatacagcctacatcggaactgagcaggctagagatctagacgacgacggtccgtagttattagttggtgcgagagtatgtaacgtactcgttactacgtacgttgggtttaacgggg

SEQ ID NO: 351222 - DNA, 588 bp, Homo sapiens
  misc_feature: GZ8MTXP02IWZ0V.39.87.H10.1.454.CMB.2.raw
  modified_base (249)..(249): a, c, t, g, unknown or other
  misc_feature (249)..(249): n is a, c, g, or t
  modified_base (361)..(361): a, c, t, g, unknown or other
  misc_feature (361)..(361): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgaggtctcctgcaggcttcnggaatcaccctcaccgacgtctatatgcactggtgcgacacggcccctggacagggcttgagtggatgggatggatacgaaccggtaacaggtggtactacgaactaaattntcggacaacgagtaagttacgagggcgagggtacaccagtcgaaccgagggacaccgtacatacaatacacgtacctaacagtagaactggaacgacgagggtcgtaggaagtacgttacgacgaaccgtacggaccgggttccgttacggttaagtttagtttacgacggtacggaaggtaagtacgtaggtacgttaactttcctttacgttaacgtttaagggg

SEQ ID NO: 351223 - DNA, 526 bp, Homo sapiens
  misc_feature: GZ8MTXP02IFP1B.39.87.H10.1.454.CMB.2.raw
  modified_base (360)..(360): a, c, t, g, unknown or other
  misc_feature (360)..(360): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggatgggatggatacgaaacggtaacaggtggtctacaactaaattangcacagtaacgtttacgaggggcaggggtaccacagtcgaaccgagggacacgtcatacaatacacgctacataggaactgacgcgagctagagatctagacgacgacggccgtagtattattgngcgaganatgagtactcgttactacgtagttagggtacggg

SEQ ID NO: 351224 - DNA, 578 bp, Homo sapiens
  misc_feature: GZ8MTXP02JQHJG.39.87.H10.1.454.CMB.2.raw
  modified_base (222)..(222): a, c, t, g, unknown or other
  misc_feature (222)..(222): n is a, c, g, or t
  modified_base (412)..(412): a, c, t, g, unknown or other
  misc_feature (412)..(412): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcaattaaaatgattagcctggtatcagcaagaaaccgaggaaactccgtaaggtcctgatctatgatgcctctaggtttggaaaggtcggggtaccctagtacgtaaggttccgagcggacaggtggatcgtggggacaggtatttcgactctcaccatcaccagcctgccgctagaagtntttcgactaacttatactagtaactaaacttaattttaacttcttaactcccgtactacgtacgtttcggggacggtacgggaaccgtaaggggtagaacgtaactaccgaaaacggtacgtggtcggacgtaacgacctacctattcgtacgttccttactaccg

SEQ ID NO: 351225 - DNA, 613 bp, Homo sapiens
  misc_feature: GZ8MTXP02G2W40.39.87.H10.1.454.CMB.2.raw
  modified_base (196)..(196): a, c, t, g, unknown or other
  misc_feature (196)..(196): n is a, c, g, or t
  modified_base (364)..(364): a, c, t, g, unknown or other
  misc_feature (364)..(364): n is a, c, g, or t
  modified_base (552)..(552): a, c, t, g, unknown or other
  misc_feature (552)..(552): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtagganacagagtcacatcacttgccgggcaagtcaggactaattaaaatgtatttacgcctaggtatcagacaagaaaccagggaaactcgtaaggtcctgatctatgatcgcctacgtaggtttaggaacgtcgggtaccagtacgtaaggtccgagcgcgaggtggatcgngggactagtattccacttcaccactactacaccacgtccgcggccggtacctagtaacgttactttacgaacttaacctttaattaccttaacgtaacctaaacttaaactttttaacttacctttaaccgtcctaccttacgtaccgggtttaccgggacggggtaacggaccggtaaggtcggaanaacgtaacgaaacgtacgtcggtacggtcaacgactaaccgtgtcttcgttactactaccg

SEQ ID NO: 351226 - DNA, 504 bp, Homo sapiens
  misc_feature: GZ8MTXP02JG47O.39.87.H10.1.454.CMB.2.raw
  modified_base (342)..(342): a, c, t, g, unknown or other
  misc_feature (342)..(342): n is a, c, g, or t
  modified_base (405)..(405): a, c, t, g, unknown or other
  misc_feature (405)..(405): n is a, c, g, or t
  modified_base (494)..(494): a, c, t, g, unknown or other
  misc_feature (494)..(494): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcattaaaatgattagctggtatcagcagaaaccagggaaaactcctaaggtcctgatctatgatgcctcagtttggaaagtggggtcccatcaggttccagcgcagtgatcngggacagattcactctcaccatcaccagcctgcggcctgaacgtatttgactacttatacgtntactaactaatttattacttatccgcttctactttcggacggaggaccgaaggtggaagagtacaaaacgactagtggactgcaacctntctctctctc

SEQ ID NO: 351227 - DNA, 502 bp, Homo sapiens
  misc_feature: GZ8MTXP02ISW1N.39.87.H10.1.454.CMB.2.raw
  modified_base (249)..(249): a, c, t, g, unknown or other
  misc_feature (249)..(249): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (474)..(474): a, c, t, g, unknown or other
  misc_feature (474)..(474): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagcctggggcctcagtgaggtctctgcaggcttcnggaatcaccctcaccgacgtctatatgcactggttgcgacacggcccctggacaggcttgagtggatggatggatcgaacgtanagtgtctacacaaattntgacacgagtaagttcgagggcagggtcacangacgaggacacgtcatacaatacagacctacattaggaactgagacgaggnacgagngtacgtagacgacgacggtcgtgtattgtgtacgngagaagatagacgttactctacgtatag

SEQ ID NO: 351228 - DNA, 508 bp, Homo sapiens
  misc_feature: GZ8MTXP02FGIXF.39.87.H10.1.454.CMB.2.raw
  modified_base (383)..(383): a, c, t, g, unknown or other
  misc_feature (383)..(383): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaatgatttagcctggtatcagcagaaaccagggaaaactcctaaaggtcctgatctatgatgcctccagttggaaagtgggtccatcaaggtcagcgcagtggatctgggacagatttcactctcaccatcaccagcctgcggccngaagtattttgacaactttatactgtacaaactaatttaaattcttaatcccgctctactttcggcggtagggaccaaaggtggagatacaaaacgaactgtaggctgctaccatctgtctctac

SEQ ID NO: 351229 - DNA, 539 bp, Homo sapiens
  misc_feature: GZ8MTXP02HSSBD.39.87.H10.1.454.CMB.2.raw
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcattagctagttattagcctggtatcaacacaagcaggcaagttccaagctctgatctattcngcatccactttacaatcaggtccccatctcgtcagtgcngtgatcgtgggacngacttcgctcncacatcagccacctgacacgcctagaaacgtnttgttcgtacttaactttattactgtaactaaaagttcttactctagaccgaaagtatagggtaacgggtaaaccgttcccggggaccccgggtactaacgggttaccaagtaacgtacgaaaacgtacgtaggtacggacttacgacc

SEQ ID NO: 351230 - DNA, 509 bp, Homo sapiens
  misc_feature: GZ8MTXP02GTVP2.39.87.H10.1.454.CMB.2.raw
  modified_base (352)..(352): a, c, t, g, unknown or other
  misc_feature (352)..(352): n is a, c, g, or t
  modified_base (403)..(403): a, c, t, g, unknown or other
  misc_feature (403)..(403): n is a, c, g, or t
  modified_base (437)..(437): a, c, t, g, unknown or other
  misc_feature (437)..(437): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcacccgacgtctatatgcactggttgcgacaggcccctggacaagggcttgagtggatgggatggatcgaacggtacagtggtctcaacaaattngcaacagtaagtttcgaggggcagggtcaccatcgacagggacacgtccancaatacagctacataggaactgagcgagctgagntctgacgacgacggcgtagtattattggacgacgagagagtgacgtactcttacgtagttagtcgggttagg

SEQ ID NO: 351231 - DNA, 499 bp, Homo sapiens
  misc_feature: GZ8MTXP02I87AU.39.87.H10.1.454.CMB.2.raw
  modified_base (338)..(338): a, c, t, g, unknown or other
  misc_feature (338)..(338): n is a, c, g, or t
  modified_base (397)..(397): a, c, t, g, unknown or other
  misc_feature (397)..(397): n is a, c, g, or t
  modified_base (478)..(478): a, c, t, g, unknown or other
  misc_feature (478)..(478): n is a, c, g, or t
tcagtcgcactagtcacgaccggtgctcgatttagcagtactgcgttgggtttggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggcattaaaatgattagctggtatcagcagaaaccagggaaactctaagtcctgatctatgatgcctctagttggaaagtgggtccatccaagttcagcgcagtggntcgtgggacagtatttcactctacacatcacagcctgcgctgaagtatttgactaattntactgtacaactaatttaatcgttatccgtctctacgttcggcggtacggaccaagggtgagactacgaaaacgactaggngactgaccaccatctcgttac

SEQ ID NO: 351232 - DNA, 538 bp, Homo sapiens
  misc_feature: GZ8MTXP02IIDOE.39.87.H10.1.454.CMB.2.raw
  modified_base (428)..(428): a, c, t, g, unknown or other
  misc_feature (428)..(428): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaaacggtacagtggtctacactaaattatgcacagtaaagtttcgaggggcaggggtacaaccgatcgaaccagggacacgtccatacaatacagcctaanataggaactgagcgaggctagagatcgtagacgacgacggccgttagtattacgttgtcgacgaagtagagtgtactaacgttcttactacgttagtgggtttaacgggg

SEQ ID NO: 351233 - DNA, 510 bp, Homo sapiens
  misc_feature: GZ8MTXP02I6DTV.39.87.H10.1.454.CMB.2.raw
  modified_base (425)..(425): a, c, t, g, unknown or other
  misc_feature (425)..(425): n is a, c, g, or t
  modified_base (450)..(450): a, c, t, g, unknown or other
  misc_feature (450)..(450): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggagtgggatggatcgaaacggtaacagtggtctacaactaaattagtgcacagtaagtttacgagggcagggtacaccagtcgaccgaggacacgtcatacaatacagcctanatagaactgagcgagtcgagagacncgtagacgacgcgcgtagtatagtgtcgcgagagagtgagtactctagtacgtagtagtg

SEQ ID NO: 351234 - DNA, 586 bp, Homo sapiens
  misc_feature: GZ8MTXP02I4NDY.39.87.H10.1.454.CMB.2.raw
  modified_base (357)..(357): a, c, t, g, unknown or other
  misc_feature (357)..(357): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacacggcccctggacaagggcttggagtggatgggatggatcgaacggtacagtggtctacactaaaattntgcaacgagtaagtttccgaaggggcagggtcaccgagtcgaaccgagggacacggtccatacaacgtacagacctaacagtacgggaaacctggacgacgaaggtcgtagaacggtactaccgtaggaaccgacgaaccggggtcccgttaaggtactttaagttcggtagaccgtaaggacgtaagtaggaacgtacttacgttacctacgttacggtttacggggg

SEQ ID NO: 351235 - DNA, 546 bp, Homo sapiens
  misc_feature: GZ8MTXP02I25MQ.39.87.H10.1.454.CMB.2.raw
  modified_base (362)..(362): a, c, t, g, unknown or other
  misc_feature (362)..(362): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggctgagtggatgggatggatacgaacggtaacagtggtactacaacgtaaattntcgacacgagtaaagtttcgagggtcaggggtacaccgagtcgggaccgaagggacacgtaccagtacaatacacgacctaacatagaactgaagcgaaggctaggagatacgtagaacgacgacggtccgtagtagttagtcgtagcgtaagaagagtgtacgtacttcgttactactttagg

SEQ ID NO: 351236 - DNA, 524 bp, Homo sapiens
  misc_feature: GZ8MTXP02HSECC.39.87.H10.1.454.CMB.2.raw
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (492)..(492): a, c, t, g, unknown or other
  misc_feature (492)..(492): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcaattaaaatgatttagctggtatcagacaagaaacaggaaactctaaggtcctgatctatgatgcctcagtttggaaagtgggtccatcaaggtccagcggcaggtgatgtggggactagactttcgactctcaccatcaccngccngcgctagaatntttgactaattattctatactaaataatttacttcttatccgctacgtactttcgggcggaagggacctaagggtcgagtactacgaaaacgtactggtacgntcggacaccgtatccttcgttaccttactacc

SEQ ID NO: 351237 - DNA, 711 bp, Homo sapiens
  misc_feature: GZ8MTXP02HAZAB.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctgggtgcagtccgggactgaggtgaagaagccgtggggcctcgagtgaaggtctctgcaaggcttctggaactcaccctcaccgacgtctatatgcacgtggtgcgacacggcccctggacaaggctgagtggagtgggatggatacgaacggtaaccaggtcggtactacgaactaaaattatcggacaacgtaaggtaacgtttcgaacggggtacgacggggttacaaccgtagtacgaccgaggggaaccaccggttcccattaaccaaatacgacgtaccctaacgtaagacggggtaaaactggaacgggacgaacgggaccgttagggaaacgtacgttaccggtaacggaacccggtaaccggtaaacccggggtccggtttaagttttaaacggttttacggttaggggttaccggaaccggggttaaggaaagggttaaccgttaggggtaaaaccggtttttaccttaccgttttaacccgtaaacgggtttttaaccgggttttaaacggggggg

SEQ ID NO: 351238 - DNA, 560 bp, Homo sapiens
  misc_feature: GZ8MTXP02HKJN7.39.87.H10.1.454.CMB.2.raw
  modified_base (247)..(247): a, c, t, g, unknown or other
  misc_feature (247)..(247): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttcnggaatcaccctcaccgacgtctatatgcactggttgcgacacggcccctggacaaggggcttggagtggatggggatggatacgaaacggtaacaggtgtctacgaacaaattatgcaacagtaaagtttcgaggggcagggtcaccagtacgacgagggacacgtaccatacaaacgtacacgcctaacagttacggaacctggaacgcgaaggtcgtagagaatcgtagacgacgacggtccgtagttattagttgtacgcgaacggagataagtagtacttcttacgtacgttagttacggtttaagggg

SEQ ID NO: 351239 - DNA, 512 bp, Homo sapiens
  misc_feature: GZ8MTXP02IQ4MB.39.87.H10.1.454.CMB.2.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (448)..(448): a, c, t, g, unknown or other
  misc_feature (448)..(448): n is a, c, g, or t
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctnagtgaaggtctctgcaggcttcnggatcaccctcaccgacgtctatatgcactggttgcgacacggcccctggacaagggcttgagtggatgggatggatcgaacggtaacagtggtctacaactaaattgtgacacgagtaagtttcgagggtcgagggtcacagtagaccgagggacacgtacatacatacagcctacatgaactgagcgagctgaganctagacgacgacgccgtntattatcgacgtacgagaagtanagtacgtactcttactattacgg

SEQ ID NO: 351240 - DNA, 513 bp, Homo sapiens
  misc_feature: GZ8MTXP02FVWXI.39.87.H10.1.454.CMB.2.raw
  modified_base (239)..(239): a, c, t, g, unknown or other
  misc_feature (239)..(239): n is a, c, g, or t
  modified_base (426)..(426): a, c, t, g, unknown or other
  misc_feature (426)..(426): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcattaaaangattagctggtatcagcagaaaccaggaaaactcctaaggtcctgatctatgatgcctcagtttggaaagtgggtccatcaggttccagcggcagtgatctgggacagatttcactctcaccatcaccagcctgcgcctgaagtatttgactaacttattactgtacaactatttaatcttactcgntctacgtttcggacggtaggacctaagggtcgaagtactacgaaacgtaacgtgtacggctgaccaaccgtatctcgtcttactacc

SEQ ID NO: 351241 - DNA, 549 bp, Homo sapiens
  misc_feature: GZ8MTXP02F56GQ.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaggcttctggaatcaccctcaccgacgtctatatgcactggttgcgacaggcccctggacaagggcttgagtggatgggatggatcgaaacggtacaggtggtctacaactaaattatgccacgagtaagtttcgaggggacaggggtacaaccgatacggaccgagggacacgtaccaatacaaactacacgcctaacagtaggaactgagacggagcgtagagacgtcgagacgacgtacggccgtagtatacgttggacgacgagagagtaagtacgtacttcgttactacgttaggttacggttagg

SEQ ID NO: 351242 - DNA, 553 bp, Homo sapiens
  misc_feature: GZ8MTXP02GWGS1.39.87.H10.1.454.CMB.2.raw
  modified_base (293)..(293): a, c, t, g, unknown or other
  misc_feature (293)..(293): n is a, c, g, or t
  modified_base (343)..(343): a, c, t, g, unknown or other
  misc_feature (343)..(343): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgaaggtctcctgcaaggcttctggaatccaccctcaccgacgtctatatgcacgtggtgcgacncggcccctggacaaggcttgagtggagtgggatggatacgaaccggtaanaggtggtactacaactaaaatttntgacaanaagtaagtttacgagggtacgagggtccaaccgagtacgaaccgaagggaccacggtaccaagtacaaaagtaccacgaccctaaacgagttacggaactagagacgaggctagagatccgagacgacgcggcgtatattagtgtcgacgagaagatgtagtactcgtactacgttagg

SEQ ID NO: 351243 - DNA, 502 bp, Homo sapiens
  misc_feature: GZ8MTXP02HW6MH.39.87.H10.1.454.CMB.2.raw
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (422)..(422): a, c, t, g, unknown or other
  misc_feature (422)..(422): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcgccgacgtctatatgcactggttgcgacacggccccctggacaagggcttgagtggatgggatggatcaacggtaacagtggtctnaacaaattntgacacagtaagtttcgagggcagggtcacatcgacagggacacgtccatacaatacagcctanatagaactgagcgagcgagagatcgagacgacgacggcgtagtattatgtacgagagaagctagatactcttactagtag

SEQ ID NO: 351244 - DNA, 521 bp, Homo sapiens
  misc_feature: GZ8MTXP02HQIDI.39.87.H10.1.454.CMB.2.raw
  modified_base (361)..(361): a, c, t, g, unknown or other
  misc_feature (361)..(361): n is a, c, g, or t
  modified_base (425)..(425): a, c, t, g, unknown or other
  misc_feature (425)..(425): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctgggcctcagtgaaggtctcctgcaaggcttctggaatcaccctcaccgacgtctatatgcactggttgcgacacggcccctaggaccaaggggcttggagtggatgggatggatacgaacggtacagtggtctcaacaaattntgacacagtaagttcgagggtcaggtcacatcgacgagggacacgtcatacaatacagacctanagtaggaactgagcgagctagagatcgacgacgacgacggtcgtagttattacgtcgtcgagagaagtatagtacgtactcttacgttacttaggg

SEQ ID NO: 351245 - DNA, 573 bp, Homo sapiens
  misc_feature: GZ8MTXP02JSJHK.39.87.H10.1.454.CMB.2.raw
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggacaattaaaaatgtaatttagcctggtatcagacaagaaaccagggaaaactcgtaaaggtcctagatctatgatcgcctacgtagtttaggaaaggtcggggtacccagtacgtaaggttccaggcggacgaggtggatcgtggggactagtatttcactctacaccatcaccagcctggccgctagaagttatttgactaaacttatactagtactaaacttaatttaacttcttaactccgtcttacgtacgtttcgggacggtaacggaccgtaagggtagaagtaactacgaaaacgtacgtggtacgactgaccacctatcgtctccttactacc

SEQ ID NO: 351246 - DNA, 618 bp, Homo sapiens
  misc_feature: GZ8MTXP02ICPP1.39.87.H10.1.454.CMB.2.raw
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
  modified_base (365)..(365): a, c, t, g, unknown or other
  misc_feature (365)..(365): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctnagtgaaggtctcctgcaaggcttcgnggaatcaccctcaccgacgtcatatgcactggttgcgacacggcccctggaccaaggggcttgagtggatgggatggatcgaaacggtaacaggtggtactacaactaaaatttaangaccaagtaagtaacggtttcgaaggggtcaaagggtcaacctagagaaccgagggacacgtacaatacaaatacacgtacctaacagtacggaacttaggaagaccggaaggcgtaaggaagacgttcgtaacgaccggaacgaaccgggtccgtaggtttaacttaaacgtttcgggtacgacggtaaggaagtagtaaggtaacgttacttacgttaacgttacgttacgggtttacggggttaacgggg

SEQ ID NO: 351247 - DNA, 550 bp, Homo sapiens
  misc_feature: GZ8MTXP02FZ05Q.39.87.H10.1.454.CMB.2.raw
  modified_base (363)..(363): a, c, t, g, unknown or other
  misc_feature (363)..(363): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggagtgggatggatcgaaccggtaacagtggtctacgaactaaattntgacaacagtaagtttcgagggcaggggtcaccagtacgaaccgagggacaccgtaccaagtacaaatacagcctaacataggaactgagcgaggctagagatacgtagaacgacgacggtccgtagttagttagttcggtagacggaagtaaggataggtacgtacttcgttacttacgtttaagg

SEQ ID NO: 351248 - DNA, 584 bp, Homo sapiens
  misc_feature: GZ8MTXP02ISOPY.39.87.H10.1.454.CMB.2.raw
  modified_base (407)..(407): a, c, t, g, unknown or other
  misc_feature (407)..(407): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggctaattaaaatgatttagcctggtatcagcaagaaaccagggaaaactccgtaaaggtcctagatctatgatgcctcaggtttggaaagtcgggtccatcgaaggttcagcgcaggtggatcgtggggactagtatttcactctacacatccaccacgcctagcgacctagaagttntttacgactaatttattactataactaaacttaatttaattcttaactccgtactcgtaacgtttcgggacggtaacggacgtaagggtcggaacgtaactaaccgtaaaaccgtacgtcggttaacggccttaacggacctaaccctagttaccttcgtttaccttacttaacccg

SEQ ID NO: 351249 - DNA, 519 bp, Homo sapiens
  misc_feature: GZ8MTXP02JEK2W.39.87.H10.1.454.CMB.2.raw
tcagtcgcactagtcacgaccggtgctcgatttagcagtactgcgttgggttgggagtcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacagcccctggacaagggcttgagtggatgggatggatcgaaacggtacaggtggtctacactaaattatgcacagtaagtttcagggcagggtcaccatgaccaggggacacgtccatacaaatacagccttaacagttaggaacctgacgacagggctagagatcagacgacgacggcgtagtatattgcgcgagaggtatggatactcttacgtactagttcggttacgggg

SEQ ID NO: 351250 - DNA, 478 bp, Homo sapiens
  misc_feature: GZ8MTXP02FZ29T.39.87.H10.1.454.CMB.2.raw
  modified_base (418)..(418): a, c, t, g, unknown or other
  misc_feature (418)..(418): n is a, c, g, or t
  modified_base (457)..(458): a, c, t, g, unknown or other
  misc_feature (457)..(458): n is a, c, g, or t
  modified_base (460)..(478): a, c, t, g, unknown or other
  misc_feature (460)..(478): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggatgggatggatcaaacggtaacagtggtctcgaacaaattatgcaacagtaagtttcgagggcagggtcaccatgacagggacacgtacatcaatacagcctanataggaactgaagcggggatcggagaacggcgacagagnngnnnnnnnnnnnnnnnnnnn

SEQ ID NO: 351251 - DNA, 512 bp, Homo sapiens
  misc_feature: GZ8MTXP02IJOMY.39.87.H10.1.454.CMB.2.raw
  modified_base (383)..(383): a, c, t, g, unknown or other
  misc_feature (383)..(383): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaaacggtacagtgtctcaacaaattatgcacagaaagtttcaggggtcagggtcacangacagggacacgtcatacatacagctacataggaactgagcgagcgtagagatacagacgacgacggacgtgtattatgtagcgaagagataagaccgtatccttacgtactagttaggtttaacgggg

SEQ ID NO: 351252 - DNA, 569 bp, Homo sapiens
  misc_feature: GZ8MTXP02HUNWD.39.87.H10.1.454.CMB.2.raw
  modified_base (223)..(223): a, c, t, g, unknown or other
  misc_feature (223)..(223): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcaattaaaatgatttagctggtatcagcaagaaaccagggaaactcctaaggtcctgatctatgatgcctctagtttaggaaggtcgggtaccagtcaaggttccagcggcagtggatcgtggggactagtactttcactctactaccatccaccgagcctgccggtacctaggtaagtatttcgactaactttattacgtatactaaattaattttatcttactccgtacttcgtacgtttcggacggtaggaaccgtaagggtcggaagacttaacgaaaacgtaacgtggtaggtactaacggaccaacctactccgttcgttcctttactacc

SEQ ID NO: 351253 - DNA, 709 bp, Homo sapiens
  misc_feature: GZ8MTXP02HS4I1.39.87.H10.1.454.CMB.2.raw
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggctctggaatccaccctcaccgacgtctatatgcactggttgcgacacggcccctggaccaaggcttgagtgagtgggatggatcaacggtaacaggtggtctacgaactaaaattagtcgacaacgtaaggtaaagttttaccgaaggggaccgtaagggggtaccaacccgaagtacggaaaccccggaagggggaacccaaccgggttacccaagttaccgaaaacttaaccgaacggaccccttaaaccaattaacggggaaaacccttaggaaggacccgtaagggggtaccctacggtaaaggaacttacccgtaagggaaaccggaaccggtaaaccgggcccggggttattaaacgtttaaagtttacggggtacggtaacggtaaaggtaacggtaacgtacggtaaacggttaaccctttacgtttaaccgttaaacggtttaacggtttacggggg

SEQ ID NO: 351254 - DNA, 505 bp, Homo sapiens
  misc_feature: GZ8MTXP02FJ5ID.39.87.H10.1.454.CMB.2.raw
  modified_base (335)..(335): a, c, t, g, unknown or other
  misc_feature (335)..(335): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcaagaaaccagggaaaactcctaaaggtcctgatcatgatgcctcagttggaaagtgggtccatcaggtcagcgnagtgatctgggacagtatttcactctcaccatcacctagcctgcggctagaagtatttgactaacttatactntacaatatttaattntactccgctactacgttcggacggtaggaccaaggtggaagactacaaaacgtactgtgactgacactactctctctactac

SEQ ID NO: 351255 - DNA, 528 bp, Homo sapiens
  misc_feature: GZ8MTXP02HQ0Y6.39.87.H10.1.454.CMB.2.raw
  modified_base (339)..(339): a, c, t, g, unknown or other
  misc_feature (339)..(339): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgattagcctggtatcagcagaaaccagggaaaactcctaaaggtcctgatctatgatgcctcagtttggaaagtggggtaccatcaaggtccagcgnagtggatctgggacagattcactctcaccatcacgacncngcgctnagtattatactactattatatactaactaaattaattacttactactactactacgttacggtacggacggaacgtaacggtaggagaactaacgaaacgtaacgtacgtaggtacgtcgacactactactcgttcttactac

SEQ ID NO: 351256 - DNA, 556 bp, Homo sapiens
  misc_feature: GZ8MTXP02I3KMX.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacaggcccctggacaggcttgagtggatgggatggatcgaacggtaacagtggtctcgaactaaattatgacaacaagaagtttcgaaggggcaggggtcaacccgagtacgaaccgaggggaacaccggtaccaagtacaaacgtacacggacctaacacgtagggaacctaggaacgaccgaggacgtaggaacgatcgtagaccgacgacggccgtagtagttatcggtagcgagaagagtgtacgtactcgttactactttagg

SEQ ID NO: 351257 - DNA, 539 bp, Homo sapiens
  misc_feature: GZ8MTXP02G4UNT.39.87.H10.1.454.CMB.2.raw
  modified_base (324)..(324): a, c, t, g, unknown or other
  misc_feature (324)..(324): n is a, c, g, or t
tcagtcgcactagtcacgaccggtgctcgatttagcagtactgcgttgggtttggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaatgattagctggtatcagcagaaaccaggaaactctaaggtcctgatctatgatgcctcagttggaagtgggccatcaagtcagcgnagtggatctgggacagtatttcactctcaccatcacagcctgcgcctgaagtatttgactaacttatactgtacaaatatttaattcttatccgtacttctacgtttcgggacggtaacggggaccgtaaaggggtcggaaggtaacgtaccgaaaacggtaacgtggtcgggacttcggaccaaccttactccgttacggttcctttactaccg

SEQ ID NO: 351258 - DNA, 557 bp, Homo sapiens
  misc_feature: GZ8MTXP02FT6B2.39.87.H10.1.454.CMB.2.raw
  modified_base (353)..(353): a, c, t, g, unknown or other
  misc_feature (353)..(353): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggcaattaaaatgattagcctggtatcagcagaaaccagggaaactccgtaaggtcctgatctatgatcgcctcgagtttaggaaagtggggtacccatccaaggttcagcggcaggtggntcgtgggacagtctttcactctacaccatcaccagcctgccggcctagtaagtatttgactaaactttattactgtactaactaatttaattcgttaactccgtcttctaacgtttcgggacggtaacgggaccgaaaggggtggaaacgtactaccgaaaacgtacgttaggcggtctacggacctactactcttacgtttcc

SEQ ID NO: 351259 - DNA, 574 bp, Homo sapiens
  misc_feature: GZ8MTXP02IVLM5.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcaacaacaggtgcccactcccaggttcagctggtacagtctggagctgagatgacgaagcctggggcctcagtgaaggtctcctgcaggcttctggttacacctttacaactatggtatcagttggtgcgacacggcccctggacaagggcttggagtggatggggatggatcgagcgtcttaacaagtcggtacaacaacaaactatgacacacgaaacctccgagggcaagacgtcaccatacgaccacagacacactaccaacgacgacgaccggacctaacgacgtacgggaccctagggaacgggacgcccgtaggaacgtactcgtacgacgacgaccggtccgtagtattacgtgtacgtacgagacgaggtaacgggtaaattacgtttacgacgttcggtaccttcgtttacg

SEQ ID NO: 351260 - DNA, 573 bp, Homo sapiens
  misc_feature: GZ8MTXP02JK7R7.39.87.H10.1.454.CMB.2.raw
  modified_base (198)..(198): a, c, t, g, unknown or other
  misc_feature (198)..(198): n is a, c, g, or t
  modified_base (366)..(366): a, c, t, g, unknown or other
  misc_feature (366)..(366): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctcctgtctgcatctggtagganacagagtcaccatcacttggccgggcaagtcagggacaattaaaatgatttagcctggtatcagcaagaaaccaagggaaaactcctaaggtcctagatctatgatcgcctcgtaggtttaggaaagtcggggtacccagtacgaaggttccagcggcaggtgatcgngggacagtattcactctacacatcacagctgcgctagaacttatttgactaaacttattactagtaactaaaacttaattttaacttacttaactcccgtacttacgtaacgtttcgggacggaaggacctaagggtgaagactaaacgaaaacggtactaggtacggactaacggacctaacctatcctttacgttacctactacc

SEQ ID NO: 351261 - DNA, 530 bp, Homo sapiens
  misc_feature: GZ8MTXP02GB0T3.39.87.H10.1.454.CMB.2.raw
  modified_base (330)..(330): a, c, t, g, unknown or other
  misc_feature (330)..(330): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagcctggtatcagcagaaacaggaaactctaaggtcctgatctatgatgcctcagtttggaaagtgggaccatcaggtccagcgnagtgatcgtgggacagtatttcactctcacatcacagcctgcgctgaagtatttgactaattattactgtacaactaattttaatcttaactccgacttctactttcgggacggtaaggggacctaaagggtggaaggtactaacgaaaacgtaacgtggtacggactcgaccaacctataccgttcgttaccttactac

SEQ ID NO: 351262 - DNA, 537 bp, Homo sapiens
  misc_feature: GZ8MTXP02I54G1.39.87.H10.1.454.CMB.2.raw
  modified_base (246)..(246): a, c, t, g, unknown or other
  misc_feature (246)..(246): n is a, c, g, or t
  modified_base (419)..(419): a, c, t, g, unknown or other
  misc_feature (419)..(419): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaggcttcnggaatcaccctcaccgacgtctatatgcactggttgcgacaggcccctggacaagggcttggagtggatggggatggatcgaaacggtacacgtggtctcaactaaattatgcaacagtaagtttcgaggggtcagggtcaccatgacagggacacgcatcaatacagcctanatagaactgagacgagctagagatctagacgacgacggccgttagtacttagttgtacggacgaagagagtaagtacgtacttacttaccgtacgttaggttacgggtttaacggggg

SEQ ID NO: 351263 - DNA, 585 bp, Homo sapiens
  misc_feature: GZ8MTXP02HBROJ.39.87.H10.1.454.CMB.2.raw
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcgagggacaattaaaatgtattagcctggtatcagacaagaaaccgagggaaaactcctaaaggtcctagatctatgatgcctcgtaggtttaggaaggtcgggtaccagtacgtaaggttccagcggacaggtggatcggtgggactagtactttcacttctacaccataccaccacgccgtggccgacctagtaagttatttacgacttaactttaattacgtagtaacttaaaacttaattttaacttacttactcccgtcttacgtacgtttcgggacggtagggaaccgaaggtggaagtactaacgaaacgtacgttaggcgtactcggacactacgtctacgttctctacc

SEQ ID NO: 351264 - DNA, 580 bp, Homo sapiens
  misc_feature: GZ8MTXP02JSU4A.39.87.H10.1.454.CMB.2.raw
  modified_base (249)..(249): a, c, t, g, unknown or other
  misc_feature (249)..(249): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctgagtgaggtctctgcaggcttcgnggaactccaccctcaccgacgtctatatgcacgtggttgcgacgacggccccgtaggaacgaaggggtcttggagtggagtgggatggatacgaacggtacagtggtactacaactaattgacgacaagtagtaagtttcgaggggtcgagggtccaacgtagacgaaccgagggacacggtacaagtacaaactacgacgacctacagtacgaactaggagacgaggtcgtaggacgtactacgacgaaccgaccgacgggtccgtagttattagttggtagtacggaagaagtactaggtacgttaccttacgtttacgtagtttaggg

SEQ ID NO: 351265 - DNA, 540 bp, Homo sapiens
  misc_feature: GZ8MTXP02GSEC1.39.87.H10.1.454.CMB.2.raw
  modified_base (359)..(359): a, c, t, g, unknown or other
  misc_feature (359)..(359): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggatgggatggatcgaacggtaacagtggtactcgacaaattntgacacgagtaagtttcgagggcagggtcacatacgacgagggacacgtccatacaatacagcctacatagaactgagacgaggctaggagatacgtacgacgacgaccgggtccgtaggttaacttagttggtacgacggtaagaagtagtagtacgttactctttacttacgtttaggg

SEQ ID NO: 351266 - DNA, 575 bp, Homo sapiens
  misc_feature: GZ8MTXP02FRCO3.39.87.H10.1.454.CMB.2.raw
  modified_base (240)..(240): a, c, t, g, unknown or other
  misc_feature (240)..(240): n is a, c, g, or t
tcagtcgcactagtcacgaccggtgctcgatttagcagtactgcgttgggtttggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaangatttagcctggtatcagcagaaaccagggaaaactcctaaaggtcctgatctatgatgcctcagtttggaaagtgggtccatcaagttccagcggcagtgatcgtgggacagtatttcactctacaccatcaccagcctgcggcctgaagtattttgactaactttattactgtacaaacttaatttaattcttatccgtacttctacgtttcgggacgggtaagggtacccgaaagggttgggaaagacgttaaccgaaaaacggtaaccgttggttacgggacccttaaggaccctaacccgtagttccctaggtttccctttacttaaccg

SEQ ID NO: 351267 - DNA, 514 bp, Homo sapiens
  misc_feature: GZ8MTXP02GY46A.39.87.H10.1.454.CMB.2.raw
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggccccctggacaagggcttggagtggatgggatggatcaacggtacagtgtctcanaattngcacagaagtttcagggcagggtcacatcgaccgaggacacgtccatcaatacagcctaanatggaactgagccgaggctagacgatcgtagacgacgaccggccgttagtattaagtgtcgacgagaagtagtaggtagtactctttacgtactttagg

SEQ ID NO: 351268 - DNA, 511 bp, Homo sapiens
  misc_feature: GZ8MTXP02GMW7F.39.87.H10.1.454.CMB.2.raw
  modified_base (357)..(357): a, c, t, g, unknown or other
  misc_feature (357)..(357): n is a, c, g, or t
  modified_base (480)..(480): a, c, t, g, unknown or other
  misc_feature (480)..(480): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggaccaagggcttgagtggatgggatggatcgaacggtacagtgtctacacaaattntgacacgagtaagtttcgagggcagggtcaccatgaccgagggacacgtcaatcaatacagacctacataggaactgagcgaggctgagatctagacgacgacggccgtagtattagtgtcgngagaagagtagagtactcttactacgttagg

SEQ ID NO: 351269 - DNA, 795 bp, Homo sapiens
  misc_feature: GZ8MTXP02HZKTX.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtcctccactccctcctgtctgctatcgtggtaggagacagacgtaccactatctacgttcggccgggacaaggtcgaggtactaaattaaaatgtattacgcctaggtatcagacaacgaaaccgaaggaaacctccgtaacggtcctagatctagtagactcgtaccttaccgtaggtttagggaaacggttccggggtaccctaagtacggtaaacggttccgacgggtcccggtagtagggttacgggtacgttacgggtacgggggtaaactacggtttaacctttacccgtaaccctttccctaacctaaacccgtactacccaacccggaccgtcccgtacgggtacccgttacgttaacgggtaaattttacggtttaacgaactttaaactttaaactttaccgttaaacttaaacctttaaaactttaaaactttttacttacccgttaactcccgtaccgtttaaccgttaccgggttaccggggaacggggtaaacggtaaccggtaaagggtggtaaaacgtaacgtaaaaccggtaaaacgttaccgttagggtccggtacttccggaaacccgtaccgtacgttccgttaccgtttaccgtttaccgttaccccg

SEQ ID NO: 351270 - DNA, 497 bp, Homo sapiens
  misc_feature: GZ8MTXP02I88J4.39.87.H10.1.454.CMB.2.raw
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (473)..(473): a, c, t, g, unknown or other
  misc_feature (473)..(473): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaggtctcctgcaaggctctggatcaccctcaccgacgtctatatgcactggttgcgacacggcccctggacgaggcttgagtggatgggatggatcaacggtaacngtgtctanacaattntgcacagtaagtttcgaggggcagggtcaccgatagacagggacacgtcatcaatacagctacagtgactgagcgagnacgagnacgtgacgacgacggtccgtagtatagttgcgtagagngatgacgtatccttatacgttagg

SEQ ID NO: 351271 - DNA, 546 bp, Homo sapiens
  misc_feature: GZ8MTXP02ICNQ7.39.87.H10.1.454.CMB.2.raw
  modified_base (247)..(247): a, c, t, g, unknown or other
  misc_feature (247)..(247): n is a, c, g, or t
tcagtcgcactagtcacgaccggtgctcgatttagcagtactgcgttgggtttgggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagcctggggcctcagtgaaggtctcctgcaaggcttcnggaatcaccctcaccgacgtctatatgcacgtggttgcgacacggcccctggacaagggctgagtggagtgggatggatacgaaacggtacagtggtctacgaactaaattatgcactagtaacgtttcgaggggcgagggtccaacccgatcgaaccgaggggaccacgtaccagtacaaactacacgacctaacagtacggaactgacgcggagtcgagagacacgtgacgacgacgtcgtagtatattgacgtacgagagagtgagtactcttactacgttagtcggtttaacggg

SEQ ID NO: 351272 - DNA, 544 bp, Homo sapiens
  misc_feature: GZ8MTXP02JX2XE.39.87.H10.1.454.CMB.2.raw
  modified_base (338)..(338): a, c, t, g, unknown or other
  misc_feature (338)..(338): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcacactcaccgacgtctatatgcactggttgcgacaggcccctggacagggctgagtggatgggatggatccgaacggtaanagtggtctcgacaattatgacacagagtttcagggcagggtcaccagtgaccagggacacgtccatcaatacacgcctacatggaactgagcgaggctagagactacgtaggaaccgacgaccgggtccgttaggttaactttacgtttcggtaggtaccgaagtaaggtatacgggtaacgttaacgttcgtttactttaaacgg

SEQ ID NO: 351273 - DNA, 647 bp, Homo sapiens
  misc_feature: GZ8MTXP02F2VSB.39.87.H10.1.454.CMB.2.raw
  modified_base (222)..(222): a, c, t, g, unknown or other
  misc_feature (222)..(222): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctnagtgaaggtctcctgcaaggcttctggaatccaccctcaccgacgtctatatgcacgtggtgcgacgacggcccctggaacgaagggcttggaggtggagtgggagtggatacgaaacggtacaggtcggtactacgaactaaaattatcgacaacaaggtaaagtttaccgaaggggtacgaagggggttaccaaacccgtagtacggaaacccgaacgggtaaccaaccgttaccaacttaaccaaaattaacccgaacgtaccccttaaagaaacgtagggaaaccgttaggaacgaccgaagggtaccgtaggaagtacgtacgacggaaccgacgaccggtacgtagttattagttgtagacggtagagtaataagtacgttacttacttacgttaactacggttaggggtttaacgggg

SEQ ID NO: 351274 - DNA, 570 bp, Homo sapiens
  misc_feature: GZ8MTXP02F42ZW.39.87.H10.1.454.CMB.2.raw
  modified_base (225)..(225): a, c, t, g, unknown or other
  misc_feature (225)..(225): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggnaagtcagggcaattaaaatgattagcctggtatcagacaagaaaccaggaaaactctaagtcctagatctatgatcgcctctaggtttaggaaaggtggggtaccctagtaccgtaaaggttcaggcggacaggtggatcgtagggactagtactttacactctaccaccatccaccagtccctaggccggtactagaacttatttcgaccttaaacttacttagttacgtacaacgaggtacctaacgtacgtttacccggaggtaccgtcggacgtaaagggacgaaggtagaaaactacgaaaacgtacgtgacgactcgacactactctacgtcttactac

SEQ ID NO: 351275 - DNA, 688 bp, Homo sapiens
  misc_feature: GZ8MTXP02JHETI.39.87.H10.1.454.CMB.2.raw
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (348)..(348): a, c, t, g, unknown or other
  misc_feature (348)..(348): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtggggcctcagtgagtctctgcagctcngatcaccncacgctctatatcgcactgtgcgacacggccctggacaaggcttgagtggatgggatggatacgaaacggtacagtcggtactacaaactaaattntagacctaaacgaagtaacgtttcgaagggggtacgtaacgggggtaccaaccgaacgtacggaacccgaacggggtaccaccggttaacccaagttaacaaaacttaccgaaaccggtacccttaaacgacgttacggaaaccgttaggaacgtacccgaaggggtactaagggaagtaacgttacgtaacgggaaacccggaaaccgggtacccggggttaccggtttaaacggtttaaattttaacggtttcgggtaacggtacgggaaaggttaagggaccttttaaaggggacgtttaaaccgtttcctttaacccgtttacgtttaaacggggg

SEQ ID NO: 351276 - DNA, 476 bp, Homo sapiens
  misc_feature: GZ8MTXP02F7UQE.39.87.H10.1.454.CMB.2.raw
  modified_base (462)..(476): a, c, t, g, unknown or other
  misc_feature (462)..(476): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggccccagtgaaggtctcctgcaaggcttctggaatcaccctcaccgacgtctatatgcactggttgcgacaggcccctggacaagggcttgagtggatgggatggatcgaacggtacaggtggtctcgaactaaattatgcacagaaagtttcaggggtcaggggtcaccatcgaccgaggacacgtccatcaaatacagcctaacataggaactgaggacgggctggacaaggcgacatagnnnnnnnnnnnnnnn

SEQ ID NO: 351277 - DNA, 513 bp, Homo sapiens
  misc_feature: GZ8MTXP02G1O8Z.39.87.H10.1.454.CMB.2.raw
  modified_base (249)..(249): a, c, t, g, unknown or other
  misc_feature (249)..(249): n is a, c, g, or t
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (454)..(454): a, c, t, g, unknown or other
  misc_feature (454)..(454): n is a, c, g, or t
  modified_base (476)..(476): a, c, t, g, unknown or other
  misc_feature (476)..(476): n is a, c, g, or t
  modified_base (500)..(513): a, c, t, g, unknown or other
  misc_feature (500)..(513): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctgagtgaggtctctgcaggctnggatcaccctcaccgacgtctatatgctacgtggttgacgaccgacggcccctaggaacgaagggtcttaggaggtggagtggggatggatacgaacggtacngtggtctacgaactaaatntagacacgtaagtagtttcgagggcgagggtacacagtacggaacgaagggaccacgacaagtacaaatacgaacgcctaaanagtacggaactgggacgcgggngtacggacgaagggccgatagagnnnnnnnnnnnnnn

SEQ ID NO: 351278 - DNA, 601 bp, Homo sapiens
  misc_feature: GZ8MTXP02HBC1N.39.87.H10.1.454.CMB.2.raw
  modified_base (356)..(356): a, c, t, g, unknown or other
  misc_feature (356)..(356): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctccgtgcaaggcttctggaatcaccctcaccgacgtctatatgcatggttgcgacacggcccctggacaagggcttgagtggagtgggatggatcaacggtacagtggtctcactaaattntgcaacagtaagtttcgagggcagggtcaaccgatcgacgagggacaccgtcagtacaatacacgacctaacagtacggaaaccgtggacgaccgtagggtactaggaaacgtagttacgtacggaacccggaaccggaaccgggttcccggttaacgttaacggtttacgtttaggtacggaccggtaaaggaaggtacgttaggtaacggttacttaccgtttacgtaaccgttttaacgggg

SEQ ID NO: 351279 - DNA, 526 bp, Homo sapiens
  misc_feature: GZ8MTXP02JA6HR.39.87.H10.1.454.CMB.2.raw
  modified_base (351)..(351): a, c, t, g, unknown or other
  misc_feature (351)..(351): n is a, c, g, or t
  modified_base (437)..(437): a, c, t, g, unknown or other
  misc_feature (437)..(437): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaaacggtacagtggtctcacaaattntgcacagtaagttcgagggcagggtcaccatcgacgaggacacgtccatcaatacagcctacatacggaactgagctaggctgganagtctgacgacgacggccgtgttattagttgacgtcgaaggagagtgaagttacctcgttacgtactaaggtttcgggtttaacggggg

SEQ ID NO: 351280 - DNA, 516 bp, Homo sapiens
  misc_feature: GZ8MTXP02IYVQN.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggattgaggtgaagaagcctggggcctcagtgaaggtctcctgcaaggcttctggaatcaccctcaccgacgtctatatgcactggtgcgacaggcccctggacaagggcttggagtggatgggatggatacgaacggtaacagtgtctacaactaaattatgcaacagtaagttcgagggcagggtcacagtgacgagggacacgtccatcaatacagacctaacagtaggaactggacgacgacgtgacgaggacgtcagagacacgctagtatagtgtacgacgagagaagtagtacgtactactactacgtagtgg

SEQ ID NO: 351281 - DNA, 537 bp, Homo sapiens
  misc_feature: GZ8MTXP02GQLCL.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcaactggtgcagtccgggactgaggtgaagaagcctggggcctcagtgaaggtctcctgcaaggcttctggaatcaccctcaccgacgtctatatgcactggtgcgacaggcccctggacaaggcttgagtggatgggatggatacgaacggtaaccaggtggtactcgaactaaaattatgacaacaaggtaagtttcgaaggggcagggtacaccagtcgaaccgagggacacgtccatcaatacacgacctacagtagaactgagcaaggctagagatcgtagacgacacggccgttagtattagttgtacgacgagagaagtgacgtactcttactacgttagtttagggg

SEQ ID NO: 351282 - DNA, 628 bp, Homo sapiens
  misc_feature: GZ8MTXP02JH29S.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggcaattaaaatgtattagctggtatcagcagaaaccgaggaaactccgtaaggtcctgatctatgatcgcctccgtagtttaggaaaggtcggggtacccatacgtaaggttccagcggcaggtcggagtcgtggggactagtactttccactctaccaacctactccaaacccgtgcccgttaggcccgggtacctaggtaaagttacgtttttacgaccttaaactttacttactacgttacctaaaacttaaattttaacttacttaccgtcctacttaccgtacgtttccggggacgggtaacggaaccgtaaggggtaggaagtaactaacgaaaacgtacgtacggtacggctaacggacctaaccgtattccgtcgttaccttacgtacccg

SEQ ID NO: 351283 - DNA, 562 bp, Homo sapiens
  misc_feature: GZ8MTXP02J041Y.39.87.H10.1.454.CMB.2.raw
  modified_base (370)..(370): a, c, t, g, unknown or other
  misc_feature (370)..(370): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtgggcctcagtgaaggtctcctgcaggcttcgtggatccaccctcgaccgacgtctatatgcacgtggttgcgacgacggcccctggacgaagggtcttggagtggagtgggatggatacgaaccggtacgagtggtactacgaactaaattntgacaacgtagtaagttcgagggtcgaggtacacagtacgaccgaggacaccgtacatacaatacgacgacctacgagtacggaactaggacgacgacggtacgaggagactacgtacgaaccgcgtaccggtcgtagttattacgttcgagacgagaagagtagtacgttacgtcttacgtacgtttaggg

SEQ ID NO: 351284 - DNA, 741 bp, Homo sapiens
  misc_feature: GZ8MTXP02IK3IF.39.87.H10.1.454.CMB.2.raw
  modified_base (197)..(197): a, c, t, g, unknown or other
  misc_feature (197)..(197): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctcctgtctgcatctgtagganacagagtccaccatcacttcgccgggacaagtcagggacaattaaaatgtatttagcctggtatcagacaagaaaaccgaaggaaacctccgtaaaggtcctagacttactatgatcgaccttacgtaggtttacggaaacggtcggggtaccctagtacgtaacggttccgacggccgtacgaggtggtacgtcggtggggtactaggttactttaccaccgttcacctacctactccgaacccgtacgtcccgtggtacccggtacttaggtaaacgttcttttacgaacttaacttttacttaacttacgttaaaccttaaaactttaactttttaacttacctttacccgttaccgtaccgtttaccgttaccggttttaccgggggaacggggtaaacgggtaacccggttaaggggttacggaaaacggtaacctttaaaccgaaaaacggttccgttaacgggttaccggccgtttaacggaccctaaacccggttctttaaccgtttaccggttttccctttaaccgttaaccccg

SEQ ID NO: 351285 - DNA, 589 bp, Homo sapiens
  misc_feature: GZ8MTXP02HM7FJ.39.87.H10.1.454.CMB.2.raw
  modified_base (149)..(149): a, c, t, g, unknown or other
  misc_feature (149)..(149): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggnggcagcagccacaggagcccactcccaggtgcagctggtgcagtccggactgaggtgaagaagcctggggcctcagtgaaggtctcctgcaggcttctggaatcaccctcaccgacgtctatatgcactggtgcgacacggcccctggacaagggctggagtggagtgggatggatacgaacggtaaccaggtgtctacaactaaattatgacaacgtagtaacgtttcgaaggggcgaaggggtccaaccgtagtacgaaccgagggaccacgtaccaagtacaaatacacgaccctaagagtacggaactgacgacgaggctaggagtactcgtacggaacgaccgtaccgggtaccgttagttaacttagttcggtagacggtaagagtaagtaggtaacgttaccgttacgtttactacgtttaggtttacggggg

SEQ ID NO: 351286 - DNA, 561 bp, Homo sapiens
  misc_feature: GZ8MTXP02HHMB5.39.87.H10.1.454.CMB.2.raw
  modified_base (356)..(356): a, c, t, g, unknown or other
  misc_feature (356)..(356): n is a, c, g, or t
  modified_base (399)..(399): a, c, t, g, unknown or other
  misc_feature (399)..(399): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcaattaaaatgattagctgtatcagcagaacaggaaactctaaggtcctgatctatgatgcctcaggtttaggaaaggtcggggtccatcaaggttccagcggcaggtggattcgtggggacagtntttacgactctacacatcacccagccctggcgtcctagaagtnttttagactaaacttattactgtactaaactaatttaacttcttaactccgtactcgtacgtttacgggacggtaacgggaccaaagggttggaacgaagtacgtaaaacgtacgtacgtagggacttaacggacaacctattacgtcgttacttactaccg

SEQ ID NO: 351287 - DNA, 683 bp, Homo sapiens
  misc_feature: GZ8MTXP02JAP53.39.87.H10.1.454.CMB.2.raw
  modified_base (252)..(252): a, c, t, g, unknown or other
  misc_feature (252)..(252): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttcnggaatcaccctcaccgacgtctatatgcactggttgcgacgacggcccctggacaagggcttgagtggagtgggatggatacgaaaccggtacaggtcggtactacaactaaattgtgacaacgtaagtaaacgtttcgaagggggtacgtaacgggggtaccaacccgtagtacggaacccggaacgggggaacctacccggttaccgaaacgttaccaaaacgttaaccgaaacggtaccccttaaacgaacggttacgggaaaccttagggaaacggaccgaacgggtccgtagggaacggtacgttaccgtaacgggaaccggaacggaaccgggtaccggttaggttaacgtttaacgttcggtacggacggaaggtaagtaacgtaggtacgttaaccttcgtttaccgttaacgtttaacgggg

SEQ ID NO: 351288 - DNA, 523 bp, Homo sapiens
  misc_feature: GZ8MTXP02GBDJQ.39.87.H10.1.454.CMB.2.raw
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggctgagtggatggggatggatcgaaacggtacagtggtctacacaaattatgcacagtaagtttcagggtcagggtcaccatgaccgagggacacgtcatcaatacagcctaacataggaactgagacgagtcngagntcngacgacgacggcgtagtattattggcgacgagagtagtaagtacgttacttcttacgtacgtaggttacgggtttacgg

SEQ ID NO: 351289 - DNA, 656 bp, Homo sapiens
  misc_feature: GZ8MTXP02FM0UT.39.87.H10.1.454.CMB.2.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatccctccctgtctgcatctgtagganacagagtcaccatcacttgccggnaagtcagggactaattaaaatgtattagctgtatcagacaagaaaccgaggaaactccgtaaggtcctagatctagtgactcgccctacgtaggtttaggaaacggtcgggtaccctagtaccgtaaggtcgagcggacgaggtgacgtcgtaggggactagttactttacactcctaccacctactcccaaccgacgcccgtcggacccggtccttaaggtaagtttactttcgaaacctttaaactttaactttaaccttacgttaaccttaaaactttaaactttttaacgtttacctttaacgttcccgttacttaccgttacggtttacggggaccgggtaacgggtaaccgtaagggtacggaaacgtaacgtaaccgaaacgttacgtggtaacgactcgacctactacgttcctactttccc

SEQ ID NO: 351290 - DNA, 583 bp, Homo sapiens
  misc_feature: GZ8MTXP02GL7DA.39.87.H10.1.454.CMB.2.raw
tcagtcgcactagtcacgaccggtgctcgatttagcagtactgcgttgggtttgggggcagtagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagcctggtatcagcagaaaccaggaaaactcctaaaggtcctgatctatgatgcctcagtttaggaaagtgggtaccatccaaggttcagcggcaggtggatcgtaggggactagtatttacactctacaccatccaccacgcctagccggctaggaagtatttcgactaacttattactgtacaaacttaatttaacttcttactccgacttctacgtttacgggacggtaacgggtaccctaaaggggttggaaacgtacgtaccgtaaaaaccggtaacgttggtaacgggtccttacggaccctaaccgtaacttcgtttacggtttccc

SEQ ID NO: 351291 - DNA, 498 bp, Homo sapiens
  misc_feature: GZ8MTXP02G0GYM.39.87.H10.1.454.CMB.2.raw
  modified_base (355)..(355): a, c, t, g, unknown or other
  misc_feature (355)..(355): n is a, c, g, or t
  modified_base (424)..(424): a, c, t, g, unknown or other
  misc_feature (424)..(424): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaacggtaacagtggtctcacaaattntgcacagaagtttcagggcagggtcaccatcgacaggacacgtcatcaatacagcctacatggactgancgagctgacgatcgtgacgacgacggtccgtagtattagttgtgcgtagaagatgactacgtcttactattagg

SEQ ID NO: 351292 - DNA, 522 bp, Homo sapiens
  misc_feature: GZ8MTXP02FOLBM.39.87.H10.1.454.CMB.2.raw
  modified_base (426)..(426): a, c, t, g, unknown or other
  misc_feature (426)..(426): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggctgagtggatgggatggatcgaaacggtaacaggtggtctacaactaaattatgcacagtaagtttacaggggcaggggtcaccatacgacgagggacacgtccatacaatacacgcctanataggaactgagacgagcgtagagatcgtagacgacgacggccgtgtattagttgtgacgagagatgacgtactctactactagtggtttaacggg

SEQ ID NO: 351293 - DNA, 558 bp, Homo sapiens
  misc_feature: GZ8MTXP02HT4T5.39.87.H10.1.454.CMB.2.raw
  modified_base (361)..(361): a, c, t, g, unknown or other
  misc_feature (361)..(361): n is a, c, g, or t
  modified_base (383)..(383): a, c, t, g, unknown or other
  misc_feature (383)..(383): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagcctggtatcagcaagaaaccaggaaactcctaaaggtcctgatctatgatgcctcgtaggtttagggaaagttcggggtacctagtacgaaggttccaggcggcaggtgatcgngggacagtattcactctcaccntcaccagcctgcgactagtagtatttgactacttattactgtactaatatttatcttatccgtcttcgtacgtttcgggacgggtacgggtaacctaaggggtacggagtaaactacgaaaacgtacgtaggtacggtctaacgaccaacctattcgtacgttcctttactaccg

SEQ ID NO: 351294 - DNA, 533 bp, Homo sapiens
  misc_feature: GZ8MTXP02IS1SE.39.87.H10.1.454.CMB.2.raw
  modified_base (357)..(357): a, c, t, g, unknown or other
  misc_feature (357)..(357): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctctgcaaggcttctggaatcacccctcaccgacgtctatatgcactggttgcgacaggccccctggacaagggcttgagtggatgggatggatcaacggtacagtggtctcgaactaaattntagcacagtaagtttcgagggcagggtcaccatgaccagggacaccgtacagtacaaatacagacctacattaggaactgagcaaggctagacgagtacagaacgacgaacggtccgtaggttaattagttcgtagacgtagaagtatacggattacgtcttacttacgtttaagg

SEQ ID NO: 351295 - DNA, 617 bp, Homo sapiens
  misc_feature: GZ8MTXP02IER3Q.39.87.H10.1.454.CMB.2.raw
  modified_base (224)..(224): a, c, t, g, unknown or other
  misc_feature (224)..(224): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctcatccctcctgtctgcatctgtaggagacagagtcaccatcacttgccggnaagtcagggcaattaaaatgtattagctgtatcagacaagaaacgaggaaactctaaggtcctagatctatgatgcctcgtagtttaggaaagtcgggtaccagtccgaaggttcgaggtcggctaaggtggacgtcggtagggtactagttactttcacttcctaccacataccaccacgtccctggcggtacctaggtaagttacttttagaccttaaacttttacttaacttacgttaacctaaaactttaaactttttaacgtttacctttaacgttcccgttacctttacgtaaccggttttccggggacgggtaacggtaaccgtaaagggtcgtaaagaacttacgaaacgtactggaacgtctacgacaaccttcttacgtactc

SEQ ID NO: 351296 - DNA, 545 bp, Homo sapiens
  misc_feature: GZ8MTXP02J0ZI7.39.87.H10.1.454.CMB.2.raw
  modified_base (253)..(253): a, c, t, g, unknown or other
  misc_feature (253)..(253): n is a, c, g, or t
  modified_base (365)..(365): a, c, t, g, unknown or other
  misc_feature (365)..(365): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcaattaaaatgattagctggtancagcagaaaccaggaaactctaagtctgatctatgatgcctcagtttggaagtgggtaccagtcgaaggtccagtcgcaggtgatcgtggggacagtatttcactctcaccntccactacgccgtgccggtcctaggaaagttacttttagacttaaactttattaacgtagtaactaaactaaatttaacttaccttatcccgtacttacgtacgtttcgggacgtagggaaccagggtgagactaccgaaaggactggtacgcgtcgcaacctgtcctagtctcttaccg

SEQ ID NO: 351297 - DNA, 670 bp, Homo sapiens
  misc_feature: GZ8MTXP02HBMEH.39.87.H10.1.454.CMB.2.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctcctgtctgcatctgtagganacagagtcaccatcacttgccggnaagtcgagggacaattaaaatgattagctggtatcagacaacgaaaccgaaggaaacctccgtaaggtctgatctatgatcgcctacgtaggttaggaaagtcgggtacctagtccgtaaggtcaggcggacaggtggtatcgtagggacagtactttcacgtcctaccactactaccaaccgacgtcccgtaggtcccggtaccgtagtaaacgttacgttttacgaaaccttaaacttttacttaaccgttacgttaaacctaaaacctttaaattttaaacctttactttaacttcccgtactttaccgttaaccggtttacgggggaccggttaaacggggaccgtaaaggggttacggaaacggtaactaaccgtaaaaacgtccgttagggtaacggtaaccgtcgtaccctaacccgttacgttaccgttacgtttccg

SEQ ID NO: 351298 - DNA, 510 bp, Homo sapiens
  misc_feature: GZ8MTXP02ILOV8.39.87.H10.1.454.CMB.2.raw
  modified_base (354)..(354): a, c, t, g, unknown or other
  misc_feature (354)..(354): n is a, c, g, or t
  modified_base (414)..(414): a, c, t, g, unknown or other
  misc_feature (414)..(414): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaaggcttgagtggatgggatggatcaacggtaacagtggtctcaacaaattntgacacagtaagtttcagggcagggtcaccatgacaggacacgtcatcaatacagcctanatgaactgagcgagctagagatcgtagacgacgacggccgtagtattatgtgcgagaagagtacggggtaaattagtttacgacttcggttaaccc

SEQ ID NO: 351299 - DNA, 543 bp, Homo sapiens
  misc_feature: GZ8MTXP02HE6FX.39.87.H10.1.454.CMB.2.raw
  modified_base (359)..(359): a, c, t, g, unknown or other
  misc_feature (359)..(359): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagcctgggcctcagtgaaggtctcctgcaaggcttctggaatcaccctcaccgacgtctatatgcactggttgcgacacggcccctggacaagggcttgagtggatgggatggatcgaaccggtacagtggtactcgaactaaattntgacaacgagtaacgtttcgagggacgtagggtacaccgagtacggaaccgagggacaccgtaccaatacaatacaagcctaacataggaactggacgcgagcgagaggatacgagacgacacggtccgtataattacttcgtacgngaaaggngtagtacgtactactacttacgtacgtagg

SEQ ID NO: 351300 - DNA, 491 bp, Homo sapiens
  misc_feature: GZ8MTXP02I8QJR.39.87.H10.1.454.CMB.2.raw
  modified_base (250)..(250): a, c, t, g, unknown or other
  misc_feature (250)..(250): n is a, c, g, or t
  modified_base (350)..(350): a, c, t, g, unknown or other
  misc_feature (350)..(350): n is a, c, g, or t
  modified_base (404)..(404): a, c, t, g, unknown or other
  misc_feature (404)..(404): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaggcttcnggaatcaccctcaccgacgtctatatgcactggttgcgacaggcccctggacaaggcttgagtggatgggatggatcaacggtacagtgtctcacaattngcacagagttcagggcaggtcacatgaccaggacacgtcatcaatacagcctanatgactgagcaggctagacgatcgtagacgacgacggccgtaggtattacgtgtgcgagaagagtagacgtactcttactacttagg

SEQ ID NO: 351301 - DNA, 621 bp, Homo sapiens
  misc_feature: GZ8MTXP02H2F9C.39.87.H10.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagtcgcactagtcacgaccggtgctcgatttagcagtactgcgttgggtttgggtgagtcagacccactcaggacacagcatggacatgagggtccccgctcagctcctggggcttctgctgctctggctcccaggtgccagatgtgacatccagttgacccagtcctccatccctccctgtctgcatctgtagganacagagtcaccatcacttgccgggnaagtcagggacaattaaaaangaatttagcctggtatcagcaagaaaccgaagggaaaactccgtaaggtccctagtatctatgatcgcctcgtaggtttaggaaaggtcggggtaccatacgaacggttcagcggactaggtggactcgtagggacagtatttcactctacaccatacaccacgcctgccgactagaagttctttgactacgtttattactagttaactaaacttaacttttattacttacgtcccgttacttacgttaccggtttcggggaccgggtaacgggtacccgtaaaggggtcgggaaactaacgtaaccggaaaacgtacgtacgggtacggtccgttacggaccctaccgtagttcccgttacgtttaccttacccg

SEQ ID NO: 351302 - DNA, 546 bp, Homo sapiens
  misc_feature: GZ8MTXP02F6DAQ.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggtgcgacgacggcccctggacgaagggcttggagtggagtgggatggatacgaaacggtaacgagtggtacctacgaactaaattatgcaacgagtaaagtttcgagggcgagggtcacgatcgacgagggacacgtacatacaactacacgtaccaacagtaggaactgacgcgaggcgtagagatcgagacgacgcggtacgtgtattagtggtgacgtagagtagtgtacgtacttacttacgtacgtagtacgggtttaacggg

SEQ ID NO: 351303 - DNA, 586 bp, Homo sapiens
  misc_feature: GZ8MTXP02IWDWZ.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttctggaatccaccctcaccgacgtctatatgctacgtggttgcgacacgggccccctggacgaagggcttggaggtggagtgggatggatacgaacggtaacaggtggtactacaactaaattatgacaacgaagtaagtttcgaaggggacaggggtaccacgagtacgaacggaggaccacgtaccatacaactacgacgtacctaacaagtacggaactaggacgacgaacggcgtagaacggatacgtaggaacgacgaacggtaccgttagtacgttagttgtacgacggtagaggtaatagtagttactacttacgtacgttagtttagggg

SEQ ID NO: 351304 - DNA, 548 bp, Homo sapiens
  misc_feature: GZ8MTXP02GTH96.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttcgcgacacggcccctggacaagggctgagtggatgggatgtatccgaaccccgagacgtggcgacaactaaaatatgcaacagagtatttcgagggcagggtcacatgacgtcgggacacgtccaataccaaaacacgacctaacagtaggaacttacgaagtagactagaagtaccaaacgacgacggaccgtagtacttctgtgacgtaggacggcgacgtacgttccgaacggtgggaagtagtcgacgtagtttacggtaag

SEQ ID NO: 351305 - DNA, 507 bp, Homo sapiens
  misc_feature: GZ8MTXP02GEV1C.39.87.H10.1.454.CMB.2.raw
  modified_base (427)..(427): a, c, t, g, unknown or other
  misc_feature (427)..(427): n is a, c, g, or t
  modified_base (462)..(462): a, c, t, g, unknown or other
  misc_feature (462)..(462): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaatgattagctgtatcagcagaaacagggaaactcctaaggtcctgatctatgatgcctcagtttggaagtgggtccatcaaggttccagcgcagtgatctgggacagatttcactctcaccatcaccagcctgcggctagaagtatttgactaatttatactgtacaaactaatttaatcttaatccgnttacactttcggacggtagggaccaagggtcgganactacgaaaacgtacgtgtaggctggcacctatctcgtcttctac

SEQ ID NO: 351306 - DNA, 523 bp, Homo sapiens
  misc_feature: GZ8MTXP02JVIKV.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggatgggatggatcgaaacggtaacacgtggtctcaacaaattatgcacagtaagtttcgagggcagggtcaccatagaccagggacacgtcatacaatacagcctacataggaactgagcgagtcgagagagtcgagacgacgacggcgtagtatacgttggacgacgacgagagtaagtacgtactactacgtacgtacgtaggtacgg

SEQ ID NO: 351307 - DNA, 597 bp, Homo sapiens
  misc_feature: GZ8MTXP02I7RCX.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagcctggggcctcagtgaaggtctcctgcaggcttctggaatcaccctcaccgacgtctatatgcacgtggtgcgacacggcccctggacaagggcttggagtgggatgggatggatcgaacggtacagtggtctacaactaaattatgacacgtaagtaacgtttcgaagggggtcacgggggttaccaacccgagtacggaaccgaacggggaaccacggtacccaatacaaataccacgacctaacagtacggaactaggaaggccgacggccgtaggagtacgtcgtacgaacggacgaaccgggtccgttagtacgttagttcggtagacgtagaagtaagtacggtaacgttactctttaccgtacttacggtttacggggg

SEQ ID NO: 351308 - DNA, 547 bp, Homo sapiens
  misc_feature: GZ8MTXP02G7MKY.39.87.H10.1.454.CMB.2.raw
  modified_base (363)..(363): a, c, t, g, unknown or other
  misc_feature (363)..(363): n is a, c, g, or t
  modified_base (446)..(446): a, c, t, g, unknown or other
  misc_feature (446)..(446): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcacgtggtgcgacaggcccctggacaagggcttgagtggatgggatggatgaacccggtaacaggtggtctacgaactaaattntcgacaacagtaagtttcgaggggtcaaggggtcaaccagtacgaaccgagggacaccgtaccaatacaatacagaccctaanacgtaggaactggagacgaggactgaagtatacgtagacgtacgacggtaccgtagttaattagtgtagcgagaaggatggactactacttactacttagg

SEQ ID NO: 351309 - DNA, 709 bp, Homo sapiens
  misc_feature: GZ8MTXP02IICNY.39.87.H10.1.454.CMB.2.raw
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgctatgtaggagacagagtcaccactactactacgtccgggccggaagtacgacgggacgtaacttaaaattaaagagtttaagtaccgcggttagtacagacgaacgaaaaccgaaacgggaaacgtaacctaacggtacgtacgtatactactagagtagcccgttacccgtacggtttaaggtaaacgggtacggggttacccgactacgtaaccgggttacgtacgacgggccgagtagggtagtacgttgggaacgacgttagtttacctactaccttaccaacctacacctacccaacgccgtacgcgggccctagtaagtatttactacgtaaactttaacctttattaacgttactaaaccttaaattttaaactttacttacttacccggtacttaccgttacgtttaccgggtacggggaacggggtaaccggtaaagggttacgggagtaagaaccgttaaacgaaaacgttgtggaacgttcgacacccattcgttagttactttaccg

SEQ ID NO: 351310 - DNA, 547 bp, Homo sapiens
  misc_feature: GZ8MTXP02GFSS8.39.87.H10.1.454.CMB.2.raw
  modified_base (361)..(361): a, c, t, g, unknown or other
  misc_feature (361)..(361): n is a, c, g, or t
  modified_base (433)..(433): a, c, t, g, unknown or other
  misc_feature (433)..(433): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctctgcaggcttctggaatccaccctcaccgacgtctatatgcactggtgcgacacggccccgtggacgagggtctggagtggagtgggatggatacgaaacggtaacaggtgtctacgaactaaattntgcaacgagtaagtttacgagggcagggtacacgatacgacgaggacacgtacagtacaactacacgctaanagtagaactgacgcgagcgtagagactcgagacgacgacgcggtatagttacgttgaggacgagaagtagtaaggtaacgtcttactacgttaagtacgttgggtttaaacggg

SEQ ID NO: 351311 - DNA, 575 bp, Homo sapiens
  misc_feature: GZ8MTXP02I4GC0.39.87.H10.1.454.CMB.2.raw
  modified_base (363)..(363): a, c, t, g, unknown or other
  misc_feature (363)..(363): n is a, c, g, or t
  modified_base (439)..(439): a, c, t, g, unknown or other
  misc_feature (439)..(439): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctctgcaggcttctggaatcaccctcaccgacgtctatatgcactggttgcgacacggcccctggacgaagggcttgaggtggagtgggatggatacgaaaccggtaacagtggtacacaacaaattntgacacgagtaagtttcgagggacgagggtacacgatacgaccgagggacacgtaccatacaaatacacgacctanagtgaactgaagcgaggctaggagtactacgtacgaaccgacgacggaccgttacggttattaacgttggtacggacgtaaggaagtagttacggtaacggttaccgtttacctttaacgttaaccgtttaagggg

SEQ ID NO: 351312 - DNA, 504 bp, Homo sapiens
  misc_feature: GZ8MTXP02H2CJN.39.87.H10.1.454.CMB.2.raw
  modified_base (359)..(359): a, c, t, g, unknown or other
  misc_feature (359)..(359): n is a, c, g, or t
  modified_base (473)..(473): a, c, t, g, unknown or other
  misc_feature (473)..(473): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcactggttgcgacacggcccctggacaagggcttgagtggatgggatggatcaaccggtacagtggtctcaacaaattntgacacagtaagtttcgaggcaggtcacatgacgaggacacgtcatacatacagcctacatagaactgagcgaggctagagatcgagacgacgacggcgtagtattagtgtcgngagaagagtagagtactcttactacgttagg

SEQ ID NO: 351313 - DNA, 547 bp, Homo sapiens
  misc_feature: GZ8MTXP02JD615.39.87.H10.1.454.CMB.2.raw
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaaccggtaacagtggtctcgaactaaattatgcaacgaagtaagtttcgaaggggtcaaggggtcaaccgagtcgacgaagggacacgtacagtacaatacagacctacataggaactggagaccgaggctaggaacgtacgttacgagaacgacgacggccgtagtattaacgttgtacgnggaagngagtgtaacgtactcttactacttaaggg

SEQ ID NO: 351314 - DNA, 590 bp, Homo sapiens
  misc_feature: GZ8MTXP02I25LA.39.87.H10.1.454.CMB.2.raw
  modified_base (526)..(526): a, c, t, g, unknown or other
  misc_feature (526)..(526): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgaggtctcctgcaggcttctggaatcaccctcaccgacgtctatatgcactggttgacgacacggcccctggacaagggcttaggagtggagtgggatggatcgaaacggtacaggtgtcacgaactaaattatgcaacaaggttaaacgtttcgaaggggtcgaaggggttccaaccgatacggaaccgagggaaccacgtaccatacaaatacacgacctaacagttacggaacttgacgtaccgagtcgtagagacgttcgacgaacgaccgacggtaccgtagttagttagttaggngtacggaagtagtagtaacgtagtaccttcttacgtaaaccgttggttacgggtttaaacgggg

SEQ ID NO: 351315 - DNA, 563 bp, Homo sapiens
  misc_feature: GZ8MTXP02HGXFE.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtgtcagcagccacaggagcccactcccaggtgcagctggtgcagtccgggactgaggtgaagaagccgtggggcctcagtgaaggtctcctgcaaggcttctggaatcaccctcaccgacgtctatatgcactggtgcgacacggcccctggacaagggctgagtggagtgggatggatacgaaacggtaacaggtggtactacaactaaattatgcaacgtaagtaaacgtttacgaggggtcgaggggttccaaccgagtacggaacccgaggggaccacgtaccaagtacaaatacagacctaacagtacggaacttggacgacgaggctaggagtactcgacgacgacgacggcgtagtattagtgtacgacgagagaatcgagtacttcgtactagtagttacggggttagg

SEQ ID NO: 351316 - DNA, 515 bp, Homo sapiens
  misc_feature: GZ8MTXP02H3WQ9.39.87.H10.1.454.CMB.2.raw
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (358)..(358): a, c, t, g, unknown or other
  misc_feature (358)..(358): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagaagccgtggggcctnagtgaaggtctctgcaggcttcnggaatcaccctcaccgacgtctatatgcactggttgcgacacggcccctggacaaggcttgagtggatgggatggatcgaacggtacaggtggtactcaacaaattntgacacagtaagtttcgagggtcagggtcacgatgaccgaggacacgtcatacaatacagccacagtagaactgagcgaggctagagatgacgacgacgacggccgtagtaattgtgtcgacgagaagagtagtacgtactcgtttactacgttagg

SEQ ID NO: 351317 - DNA, 712 bp, Homo sapiens
  misc_feature: GZ8MTXP02G0ERQ.39.87.H10.1.454.CMB.2.raw
  modified_base (198)..(198): a, c, t, g, unknown or other
  misc_feature (198)..(198): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttggccgggacaagtcaggacaattaaaatgtatttagcctggtatcagacaagaaaccaggaaaactccgtaaggtcctagatctatgatcgcctcgtagtttaggaaacggttcggggtacccctaagtacgtaaggttcccgaaggtccggtacgaggttggaacgttccgggtgggggaactacggttaacttttaccgaccttacctaccctaaccctaacttacccgaaacccgtacggtacccggtcggcccggggtaccctagggttaaagtttaacgtttttcgaaactttaaaccttttaagtttaaccgtaggttaaacctaaactttaaaactttttaactttcccttaacgttcccgtacttaccgttaccggtttccgggaagggtaacggtaaccgtaagggttcggaaaagtacgtaaacgaaaacggtacgttcggtaggtacctaacgtaccacctagtccgttacttccttacttaccg

SEQ ID NO: 351318 - DNA, 531 bp, Homo sapiens
  misc_feature: GZ8MTXP02H865F.39.87.H10.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (457)..(457): a, c, t, g, unknown or other
  misc_feature (457)..(457): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtccgggactgaggtgaagagcgtgggcctnagtgagtctctgcagcttcngatcaccctcaccgacgtctatatgcactggtgcgacgacggcccctaggacgaaggtcttaggaggtggagtggggatagggactacgaaaccggtacaggttggtactacgaaactaaagttactagacaacgtagttaagtttcgaggcgaaggtcaacagtacgacgaggacacgtacatacactacacgactacagtagaactgagngagtcgagacgtgtacgagacgagacgcgatatagtgtcgagagaagagacgtacgtacgtactacgtacgtag

SEQ ID NO: 351319 - DNA, 574 bp, Homo sapiens
  misc_feature: GZ8MTXP02GUJKX.39.87.H10.1.454.CMB.2.raw
  modified_base (222)..(222): a, c, t, g, unknown or other
  misc_feature (222)..(222): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggacaattaaaaatgaatttagcctggtatcagcaagaaaaccaagggaaaactcctaaaggtcctagatctatgatgcctcgaagtttggaaagtgggtaccatacgaaggttcagcgcagtgatcgtgggacagtacttcactcacaccatcaaccagccctgccgtacctagaaagtatttacgactaaactttattaactgtaactaaataaatttaacttactaacgtccacttctacgtttcgggacggtaagggaaccaaaggtcggaaataacgtaacaaaacggtaacgttgacggtactaacggacctaaccgtatccttagttcttacttaacc

SEQ ID NO: 351320 - DNA, 521 bp, Homo sapiens
  misc_feature: GZ8MTXP02H8RGV.39.87.H10.1.454.CMB.2.raw
  modified_base (248)..(248): a, c, t, g, unknown or other
  misc_feature (248)..(248): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (357)..(357): a, c, t, g, unknown or other
  misc_feature (357)..(357): n is a, c, g, or t
  modified_base (424)..(424): a, c, t, g, unknown or other
  misc_feature (424)..(424): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtgggcctcagtgaaggtctcctgcaaggcttcnggaatcaccctcaccgacgtctatatgcactggttncgacnggcccctggacaaggcttgagtggatgggatggatacgaaccggtaacaggtggtactcaacaaattntgacaactagtaaagtttcaggtcaggtacacatcgaccgagggacacgtcagtacatacagcctanatgaaactgagacagctagagatcagaacgacgacggtccgtagttattagttacgtgacgagaagtataggactaacgttctaccttaaacttggg

SEQ ID NO: 351321 - DNA, 560 bp, Homo sapiens
  misc_feature: GZ8MTXP02HFCLZ.39.87.H10.1.454.CMB.2.raw
  modified_base (379)..(379): a, c, t, g, unknown or other
  misc_feature (379)..(379): n is a, c, g, or t
  modified_base (475)..(475): a, c, t, g, unknown or other
  misc_feature (475)..(475): n is a, c, g, or t
  modified_base (540)..(540): a, c, t, g, unknown or other
  misc_feature (540)..(540): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttcgtggaatcaccctcaccgacgtctatatgcactggttgcgacacggccccctggaccgaagggcttggagtggatggggatggatacgaaacggtaaccagtggtctacaaactaaaattatgaccaanaagtaaagtttccgaaggggcaaggggtaccaacccagtacgaccgaaggggaaccacgtacccaatacaaatacacgacctaacaataggtaacngagacaggctagagatcgagacgacgacgcgtagtattagttagcgagagagaagtgacgtactnttacctacgttagttagggg

SEQ ID NO: 351322 - DNA, 533 bp, Homo sapiens
  misc_feature: GZ8MTXP02JY0JJ.39.87.H10.1.454.CMB.2.raw
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (427)..(427): a, c, t, g, unknown or other
  misc_feature (427)..(427): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctctgcaaggcttctggaatcaccctcaccgacgtctatatgcactggttgcgacacggcccctggacaagggcttggagtggatgggatggatcgaaaccggtacagtggtctcaactaaattntgacacagtaagttcgaggggcagggtcaccngtacgacgagggacacgtcaatcaatacagcctanagtcgaactggagcgaagggtctacggaagagtccgtagaacgacgacgggtccgtagtacttatggtcgacgagaagagtgacgttactctttacgtacgttagg

SEQ ID NO: 351323 - DNA, 552 bp, Homo sapiens
  misc_feature: GZ8MTXP02GEYK6.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggcccctggacaagggcttggagtggatgggatgggatcgagcgcttacaatggtacacaacaaactatcgacacacgaaacctccgaggggccaaggacgtcaaccatacgaccacagaacacactccacgacgcacggcctacatcgggacctggaggacgccgtagacgagtctagaaccgacgacggccgtagtacttacgtgtcgacgagagaggtaacggggtaaattgtttacgacgttacggttacccttcgtttacg

SEQ ID NO: 351324 - DNA, 698 bp, Homo sapiens
  misc_feature: GZ8MTXP02HSTEC.39.87.H10.1.454.CMB.2.raw
  modified_base (357)..(357): a, c, t, g, unknown or other
  misc_feature (357)..(357): n is a, c, g, or t
tcagtcgcactagtcacgaccggtgctcgatttagcagtactgcgttgggtttgggggagcatcacccagcaaccacatctgtcctctagagaatcccctgagagctccgttcctcacaatggactggacctggaggatcctcttcttggtggcagcagccacaggagcccactcccaggtgcagctggtgcaggtccgggactgaggtgaagaagccgtggggcctcgagtgaaggtctccgtgcaaggtcttcgtggaatccaccctcaccgacgtctatatgctacgtggttgcgacgacggcccctaggaacgagggtcttaggagtggagtgggatggatacgaacggtacngtgtctacaacgtaaattgtcgactaacgtagtaacggtttcgaggggtcgtacggggtccaaacccgtagtacgggaacccgaagggggaccctaaccggttacccaagttaaccgaaaacttaacccgaacggaaccccctttaagaaacgtttacgggaaaaccgtgggaacgaccgtaagggccgttaggaaacgtcgttacgtacggaacccggacgtaaacccggggttccggttaagtttaaagtttacgttcgggttacggtacggtaaggaaggtaacgttaggttaacggttacctttacccggtttaccttaacccgggtttaaaggggg

SEQ ID NO: 351325 - DNA, 571 bp, Homo sapiens
  misc_feature: GZ8MTXP02GQVE6.39.87.H10.1.454.CMB.2.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (492)..(492): a, c, t, g, unknown or other
  misc_feature (492)..(492): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtagganacagagtcaccatcactcgcgggnaagtcagggcaattaaaatgattagcctggtatcagcaagaaaccagggaaaactccgtaaaggtcctagatctaatgatcgcctcgtaggtttacggaaaggttcggggtaccctataccgtaaaggttcccgaggcggacaaggttggaattcggtggggacaggtaatttccactctacaccgatccaccagcctgcgtcctagtaagtactttgactaactttatactatactaaatatttaattactacgtcactcgtacgttcggnggaggacctaaagggtgaagactaacgaaaacggtacgtacggtcgactcgacgtactactccgtacgttcttactacg

SEQ ID NO: 351326 - DNA, 612 bp, Homo sapiens
  misc_feature: GZ8MTXP02IB300.39.87.H10.1.454.CMB.2.raw
  modified_base (363)..(363): a, c, t, g, unknown or other
  misc_feature (363)..(363): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcacgtggttgcgacaggcccctggacaaggcttggagtgggatgggatggatacgaacggtaacgaggtgtctacgaataaaattntgacaactagtaaacgtttacgaggggactaggggtaccacgaacgtgaaccgacgggacacgttaccgaataccaaacttacacgtaccctacgaagtacggaacgttaggaaggtacggacgtaggaaggacttacgtacggaccgacgaaccgggtccgtaggtttacttagtttacggaggtacgagtaaggtataaggtacttaacgttcttacgttacgtttagttacggggtttaacggggg

SEQ ID NO: 351327 - DNA, 535 bp, Homo sapiens
  misc_feature: GZ8MTXP02FNZDH.39.87.H10.1.454.CMB.2.raw
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
  modified_base (428)..(428): a, c, t, g, unknown or other
  misc_feature (428)..(428): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggagtgggatggatcaacggtanagtggtctnaacaaattngcacagaagtttcgaggggcagggtcaccagtacgaccgagggaccacgtaccatacaaatacagcctaanagtaggaactgagcgaggctgagatctgaacgacacggccgttagtattacgttcggtagacggagaagtagtaggtaacgttacttactttaccgtacgtttaagg

SEQ ID NO: 351328 - DNA, 549 bp, Homo sapiens
  misc_feature: GZ8MTXP02JTNHM.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtcccctgcaaggcttctggaatcaccctcaccgacgtctatatgcactggttgcgacaggcccctggacaaggctgagtggatgggatggatcgaacggtacaggtcggtctcactaaattatgcacgagtaagtttcaggggcagggtcacgagtgaccgaggacacgtccatcaatacacgctacagtcggaatgagcgaggactgagatcgtagaccgacgacggtccgtagtacgttagtcggtacgacggtagacgtagtaggaacgttacttacgttactaaccgttaggttacggggtttacggggttaaag

SEQ ID NO: 351329 - DNA, 644 bp, Homo sapiens
  misc_feature: GZ8MTXP02H2KBF.39.87.H10.1.454.CMB.2.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (311)..(311): a, c, t, g, unknown or other
  misc_feature (311)..(311): n is a, c, g, or t
  modified_base (619)..(619): a, c, t, g, unknown or other
  misc_feature (619)..(619): n is a, c, g, or t
tcagtcgcactagtcacgaccggtgctcgatttagcagtactgcgttgggtttgggggagtcagacccactcaggacacagtatggacatgagggtccccgctcagctcctggggcttctgctgctctggctcccaggtgccagatgtgccatccagttgacccagtctccactcctccctgtctgcatctgtagganacagagtcacatctacttcggccggganagtcgagggactaaattaaaatgtaatttacgcctaggtatcagacaagaaaccgaaggaaacctcgtaaggtcctagatactangactcgcctacgtaggtttaggaacggttcgggtaccagtacgtaaggtcacggcggacgtaggtacggtactcggtacgggactagttactttacccacttcctacctaacctactaccccacgaccgtcccgtggacccggtacttaaggtaacgttattttacgaacctttaaactttacttaacgttcttaaaccttaaaactttatttttaacctcttacgtaccgtcttacgtttacgtacgggacgggacggaacgtaggtacgaagtactaaacgaaaacgtcgttgacgtcacgtaacnctagtcgtctacttcgaccttcccg

SEQ ID NO: 351330 - DNA, 576 bp, Homo sapiens
  misc_feature: GZ8MTXP02JWIZ9.39.87.H10.1.454.CMB.2.raw
  modified_base (352)..(352): a, c, t, g, unknown or other
  misc_feature (352)..(352): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggtgcgacaggcccctggacaaggcttggagtgggatgggatggatcgaacggtaaccagtgtcgtacaaacncctatcgcgactagtagttacgtacggacgacgtacgtaccgactacgtacgacggacgacgtacactacaactactacgacctacacgtaggaacgtacgacggacgcgacgtacgacgtacgtacgtacgacggaaccgtaccggtaccggtacgtacgttagttacgacgtacggaggtagtaagtacgtacgtacgttacttacgttacgttacggacgg

SEQ ID NO: 351331 - DNA, 566 bp, Homo sapiens
  misc_feature: GZ8MTXP02G04EY.39.87.H10.1.454.CMB.2.raw
  modified_base (370)..(370): a, c, t, g, unknown or other
  misc_feature (370)..(370): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcagtgaaggtctcctgcaaggcttctggaatcaccctcaccgacgtctatatgcactggttgcgacacggcccctggacgaaggcttggagtggagtgggatggatacgaaaccggtaacgagtggtactacgaactaaattntcgacaacgagtaagtttcgaagggcgagggtacacgagtacgaccgaagggaccacgtaccaatacgaaatacaacgacctaacagtacggaactggaacgcgacggctaggagtactacgtagaaccgacgacggccgtagtagttagttcgtagacggagaagagtagtacgtacttcttactacgtttaggg

SEQ ID NO: 351332 - DNA, 589 bp, Homo sapiens
  misc_feature: GZ8MTXP02HBPCJ.39.87.H10.1.454.CMB.2.raw
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (336)..(336): a, c, t, g, unknown or other
  misc_feature (336)..(336): n is a, c, g, or t
  modified_base (452)..(452): a, c, t, g, unknown or other
  misc_feature (452)..(452): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctnagtgaggtctctgcaggcttcnggatcaccctcaccgacgtctatatgcacgtggttgcgacgacggcccctggacagggcttgagtggatgggatggatcgaaccggtanagtggtctacaactaaattgtcgacaacgtagtaagtttacgaggggtcagggtaccaccgtagtacggaccgaggggtaccaccgtaccaagtaccaaataccgacgacctaaanacgtaggaactaggacgacgagggtctaggagtacgtacgtacgaaccgacgaccgggtccgttagttaacgttagtttcggaggaccgtaggaagtagtacggtacgttacttacgtttacgttaacgtttacggg

SEQ ID NO: 351333 - DNA, 521 bp, Homo sapiens
  misc_feature: GZ8MTXP02GD1CX.39.87.H10.1.454.CMB.2.raw
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacaggcccctggacaaggcttgagtggatgggatggatcgaaacggtacagtggtctacaacaaattatgcaacagaagtttcagggcagggtcaccatgaccgaggacacgtccatcaatacagaccctaacatacggaactcgaagacaggctagaagatcgtagacgacgacggccgtagtacttagttgtgacgagtagaatagacgtactcttaccgtactagtttagggg

SEQ ID NO: 351334 - DNA, 587 bp, Homo sapiens
  misc_feature: GZ8MTXP02I7ME9.39.87.H10.1.454.CMB.2.raw
  modified_base (180)..(180): a, c, t, g, unknown or other
  misc_feature (180)..(180): n is a, c, g, or t
  modified_base (359)..(359): a, c, t, g, unknown or other
  misc_feature (359)..(359): n is a, c, g, or t
  modified_base (471)..(471): a, c, t, g, unknown or other
  misc_feature (471)..(471): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtncagctggtgcaggtccggactgaggtgaagaagccgtggggcctcgagtgaaggtctcctgcaaggtcttcaggaactccaccctcaccgacgtctatactgcacgtggtgacgacacgggccccctaggaacgaagggtcttaggaggtggagtgggatggatacgaaacggtaaccnggtggtactacaactaaattatcgacaacgtaaggttaacgtttccgaagggtcgaagggtcaaccgagtacgacgacgggaacacgtaccagtacaagtacacgtacctanaagtacggaactgagcgagtgtagaagcttacgagacgacgacggtccgttagtacgttaagttggtacgacgtaagagtaagtacggattactccttacgtagtacgtttagggg

SEQ ID NO: 351335 - DNA, 478 bp, Homo sapiens
  misc_feature: GZ8MTXP02G34HP.39.87.H10.1.454.CMB.2.raw
  modified_base (358)..(358): a, c, t, g, unknown or other
  misc_feature (358)..(358): n is a, c, g, or t
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
  modified_base (460)..(478): a, c, t, g, unknown or other
  misc_feature (460)..(478): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctactatgcactggttgcgacacggcccctggacaagggcttgagtggatgggatggatcaacggtaacagtggtctacacaaattntgacacagaagtttcagggtcagggtcaccatgacaggacacgtccatacaatacagcctaacatagaactgagacggcgtcggnaaacggcgaganaaggnnnnnnnnnnnnnnnnnnn

SEQ ID NO: 351336 - DNA, 605 bp, Homo sapiens
  misc_feature: GZ8MTXP02JQK4L.39.87.H10.1.454.CMB.2.raw
  modified_base (198)..(198): a, c, t, g, unknown or other
  misc_feature (198)..(198): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccgggcaagtcaggactaattaaaatgtatttagcctggtatcagcaagaaccaaggaaactcgtaagtctagatctatgatcgcctcgtaggtttaggaaaggttcggggtacccagtacgtaaggttccgaggcggactaggtggatcgtggggactagtacttcactctcacatccacacgcctgccgtactagaagttatttcgactaactttattactagtactaaacttaatttaacttcttaacgtcccgtacttcgtaaccggtttcggggacgggtaacggggtaacctaaggggtacggaaagtaacgtaaacgaaaacggtacgtgggtacggtactaacggtaccctacctagttccgttacgtttcctactaccc

SEQ ID NO: 351337 - DNA, 545 bp, Homo sapiens
  misc_feature: GZ8MTXP02GYAC2.39.87.H10.1.454.CMB.2.raw
  modified_base (251)..(251): a, c, t, g, unknown or other
  misc_feature (251)..(251): n is a, c, g, or t
  modified_base (366)..(366): a, c, t, g, unknown or other
  misc_feature (366)..(366): n is a, c, g, or t
  modified_base (450)..(450): a, c, t, g, unknown or other
  misc_feature (450)..(450): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (520)..(520): a, c, t, g, unknown or other
  misc_feature (520)..(520): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtggggcctcagtgaaggtctcctgcaaggcttcgnggaatccaccctcaccgacgtctatatgcactggtgcgacgacggcccctggacgaagggtcttaggaggtggagtgggatggatacgaaccggtacagtgtctacaactaattncgacacgtagtacgtttacgagggtcgacgggtacacgagtacgaccgagggacaccgtacacgtacaaactacacgacctaanagtacggactgagcgagngtacgagngtacagacgacgacggtcgtagtagttacgtgcgagtagaagtnaggtactactacgtactacgttagg

SEQ ID NO: 351338 - DNA, 517 bp, Homo sapiens
  misc_feature: GZ8MTXP02GR6LO.39.87.H10.1.454.CMB.2.raw
  modified_base (289)..(289): a, c, t, g, unknown or other
  misc_feature (289)..(289): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaaccctcaccgacgtctatatgcactggttncgacaggcccctggacaagggcttgagtggatgggatggatcaaaccggtaangtgtcanaanaatatnananagtagtagagagagacacanagacgagacgacacanacaanaacanacacataganagagacgagacgtagagatacgtacgacgaacgacggtacgtacgtattagttacgtacgagagaagtagtagtacgtacttacttacttaacgttacg

SEQ ID NO: 351339 - DNA, 627 bp, Homo sapiens
  misc_feature: GZ8MTXP02F8VC1.39.87.H10.1.454.CMB.2.raw
  modified_base (222)..(222): a, c, t, g, unknown or other
  misc_feature (222)..(222): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcaattaaaatgtatttagcctggtatcagcaagaaaccaagggaaaactccgtaaaggtcctagatctatgatcgcctcgtaggttaggaaaggttcgggtaccagtcgaaggttccagcggacaggtgatcgtgggacagtacttcactctcactactccaccacgcctggcccgtccgtagtaaagttacttttcgaaccttaaactttactttaacgtacgttaaccttaaaactttaaactttttaactttaccttaaccttcccgttacttaccgttaccgtttacggggacgggtaacggggtaaccgtaaggggtaggaaacgtaactaaccgaaaacgtcgtacggtcggactaacgacctactacgttccttacgtccttactaccc

SEQ ID NO: 351340 - DNA, 508 bp, Homo sapiens
  misc_feature: GZ8MTXP02G99Z9.39.87.H10.1.454.CMB.2.raw
  modified_base (354)..(354): a, c, t, g, unknown or other
  misc_feature (354)..(354): n is a, c, g, or t
  modified_base (418)..(418): a, c, t, g, unknown or other
  misc_feature (418)..(418): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaacggtacagtgtctcacaaattntgcacgagaagtttcgagggcagggtcaccatcgacgagggacacgtcatacaatacagcctanatagaactgagcaggctagagatacgtgacgacgacggccgtagtattacgttgagtcgagaagatagtacgtactcttactacgttagg

SEQ ID NO: 351341 - DNA, 573 bp, Homo sapiens
  misc_feature: GZ8MTXP02HC6LP.39.87.H10.1.454.CMB.2.raw
  modified_base (346)..(346): a, c, t, g, unknown or other
  misc_feature (346)..(346): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgtattagctggtatcagcaagaaaccagggaaactcctaaggtcctgatctatgatgcctctagttaggaagtcgggtccagtcaggtccagcgcaggtgatcgngggacagtatttcacgttctcacctatcaccagcctgccgctagaagttatttcgactaactttattactagtactaaacttaatttaattcttaactccgtacttaccgtacggtttacgggacgggtaacggaaccgtaaaggggtcgaaacgtaaacgttaaccgaaaacggtagtacggttgaccgtaagcctaaaccgttacttcgttacgttccttactcg

SEQ ID NO: 351342 - DNA, 527 bp, Homo sapiens
  misc_feature: GZ8MTXP02I4QQE.39.87.H10.1.454.CMB.2.raw
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcattagcagctggttancctggtatcagcaagaaaccgaggaaacncccctaagctccngatctatgctgcatccagtttgactaaaggtcggggtcccagtcaaggttcagtcggcagtggatcgtagggacagtattcactctacacatcagcagcctagcagcctagtaagtattttgacctaatttactattacgtacaacgaggtactaacgtacgtttaccgaggtacgttcggacgtaaagggactaaggtacgaaatacgaaacgaacgtgtacggctacgacacta

SEQ ID NO: 351343 - DNA, 535 bp, Homo sapiens
  misc_feature: GZ8MTXP02F14L2.39.87.H10.1.454.CMB.2.raw
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
tcagtcgcactagtcacgaccggtgctcgatttagcagtactgcgttgggtttgggggaggtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccggcaagtcagggcaattaaaangatttagcctggtatcagcaagaaaccaagggaaaactcctaaaggtcctagatctatgatgcctctagtttggaagtgggtccatcaagttccagcgcagngangtgggacagtattcactctcacactcaccagacctgccgctagaagttntttgactaattattactgttacctaaataatttaattcttaatccgtactctacgttcggacggtaagggacctaaagggtcgaagtaactaacgtaaacgtaagtcgtggcctaagcaaaccttctctacttctactac

SEQ ID NO: 351344 - DNA, 513 bp, Homo sapiens
  misc_feature: GZ8MTXP02IP4CH.39.87.H10.1.454.CMB.2.raw
  modified_base (357)..(357): a, c, t, g, unknown or other
  misc_feature (357)..(357): n is a, c, g, or t
  modified_base (423)..(423): a, c, t, g, unknown or other
  misc_feature (423)..(423): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaacggtacagtggtctcaacaaattntgcacgagtaagtttcgagggcaggggtcaccgatgaccagggacacgtcatacaatacagcctanatggaactgagcgaggctgagatcgtagacgacgacggtcctaggttattagttgtacgcgtagaagatgacgtactcgttctagttagg

SEQ ID NO: 351345 - DNA, 611 bp, Homo sapiens
  misc_feature: GZ8MTXP02GWMH1.39.87.H10.1.454.CMB.2.raw
  modified_base (297)..(297): a, c, t, g, unknown or other
  misc_feature (297)..(297): n is a, c, g, or t
  modified_base (394)..(394): a, c, t, g, unknown or other
  misc_feature (394)..(394): n is a, c, g, or t
tcagtcgcactagtcacgaccggtgctcgatttagcagtactgcgttgggtttggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcgaggactaattaaaatgtattagcgtgtatcagcaagaaacgaaggaaactcgtaaggtcctgactctagngatgcctctagtttaggaaggtcgggtaccatacgtaggtccaggcgacaggtgatcgtggggacaggtactttacactctacacctatccgaaccncgccgtggcccgaccttaggaaagttattttacgacttaaactttaatttacgtagttaactaaaacttaattttaattacctttaacgtccctcctacgttaacgtttccgggacggggtaacgggaaccctaaaggggttggaacgtaataacccgaaaaggtacctggtccggacctaacgtacccaacttctcgtttactactactttccccg

SEQ ID NO: 351346 - DNA, 493 bp, Homo sapiens
  misc_feature: GZ8MTXP02FG4R7.39.87.H10.1.454.CMB.2.raw
  modified_base (354)..(354): a, c, t, g, unknown or other
  misc_feature (354)..(354): n is a, c, g, or t
  modified_base (413)..(413): a, c, t, g, unknown or other
  misc_feature (413)..(413): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagctggggcctcagtgaaggtctcctgcaaggcttctggaatcaccctcaccgacgtctatatgcactggttgcgacaggcccctggacaagggcttgagtggatgggatggatcaaccggtacagtggtctcacaaattntgcacagaagtttcagggcagggtcaccatgacagggacacgtcatcaatacagcctanatgaactgagcgaggctagagatcgtagacgacacggccgtgtattatgtcgcgagaagatagacgtactctactactag

SEQ ID NO: 351347 - DNA, 521 bp, Homo sapiens
  misc_feature: GZ8MTXP02I4AAH.39.87.H10.1.454.CMB.2.raw
  modified_base (358)..(358): a, c, t, g, unknown or other
  misc_feature (358)..(358): n is a, c, g, or t
  modified_base (422)..(422): a, c, t, g, unknown or other
  misc_feature (422)..(422): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcaccgacgtctatatgcactggttgcgacaggcccctggacaaggctgagtggatgggatggatcgaaacggtaacagtggtctacgaactaaattntgcaacgagtaagttcgagggcagggtcaccatcgacaggacacgtccatcaatacacgcctanatggaactgagcgagtcgagacgatcgtacgaacgacgacggtcgtagtattagtagtgacgagtagaagtgactacgtcttactacgttagttacggg

SEQ ID NO: 351348 - DNA, 544 bp, Homo sapiens
  misc_feature: GZ8MTXP02FZW2Q.39.87.H10.1.454.CMB.2.raw
  modified_base (197)..(197): a, c, t, g, unknown or other
  misc_feature (197)..(197): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcagcatcacttgccggcaagtcagggcaataaaatgatttagcctggtatcagcaagaaaccaggaaactcctaaggtcctgatctatgatgcctcagtttggaaagtcgggtaccatcaacggttcagcgnagtggatcgtgggacagtacttcactctcacatcacngcctgcgcctgaagtntttagactaaactttatactgtacaacttaatttaagttacttatccgacttactacgtttcgggacggtaacggaacctaagggttacggagtaaacttacgaaaaccgtaacgtggtacggctaggacctaccgattcgtcgttactttaccg

SEQ ID NO: 351349 - DNA, 593 bp, Homo sapiens
  misc_feature: GZ8MTXP02JGHWZ.39.87.H10.1.454.CMB.2.raw
  modified_base (225)..(225): a, c, t, g, unknown or other
  misc_feature (225)..(225): n is a, c, g, or t
  modified_base (443)..(443): a, c, t, g, unknown or other
  misc_feature (443)..(443): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggnaagtcagggacaattaaaatgtattagcctggtatcagacaagaaaccgagggaaaacctccgtaaaggtcctgatactatgatcgccctccgtaaggtttggaaaagtcggggtccccaagtcccgtaaaggttcgaggcggacaggttggattcgtaggggaactagtatttacgactctaccacactccacccagtccctgccgcctagtaaatnttttagactaaactttattactcgttactaaacttaatttaacttcttaactccgtactccgtacgtttcgggacggtaacgggaccgtaagggtacggaagtactacgaaaacgtacgtgtaacggctacgactacctatctcgttacc

SEQ ID NO: 351350 - DNA, 522 bp, Homo sapiens
  misc_feature: GZ8MTXP02G29RG.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaatgattagcctggtatcagcagaaaccagggaaaactcctaaggtcctgatctatgatgcctcagtttggaagtgggtccatcagtccagcgcagtgatcgtggggacagatttcactctcaccatcaccagcctagcgcctgaagtattttgactaacttattactgtactaaactaatttaattacttaactccgtcttctactttcggacggtacgggaccctaaagggtggaagtactacaaaacggtactgtaggctgcaacctatcctgtcttactac

SEQ ID NO: 351351 - DNA, 742 bp, Homo sapiens
  misc_feature: GZ8MTXP02I2ASU.39.87.H10.1.454.CMB.2.raw
  modified_base (230)..(230): a, c, t, g, unknown or other
  misc_feature (230)..(230): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaacgccgtggggcctnagtgaaggtctcctgcaaggtcttcgtaggaactccaccctcaccgacgtctatatcgactacgtggttgaccgacgcggccccgtaggaaccgaagggtcttggagtcggagtgggatggatacgaaccggtaacagtcggtactacgaaactaaagttagtcgaccgtaaacgaaggttaacggtttacggaagggggtaccgtaaacgggggttccaaaccgtagtacggaacccgaggggtaaacctacccggttacaacttacccaaaagttaccgaaacggtacccccttaaagaacggtttaacggggaaccttagggaaacgaccggaagggtaccgtaagggaacgtacgttacgacggaaacccggttaacggaccgggttacccggtttacgtttaaaacgttcgttttaacgggggtacggtaacggtaaacgggtaaggttaacgttaacggttaaccgtttaccgtttaccggtttaacgtttaaacggtttacgggg

SEQ ID NO: 351352 - DNA, 563 bp, Homo sapiens
  misc_feature: GZ8MTXP02FW70V.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccgggcaagtcagggcaattaaaatgatttagcctggtatcagcaagaaaccagggaaaactcctaaggtcctgatctatgatgcctcagtttggaagtcgggtccatcaaggttccagcggacaggtggatcgtggggacagtatttcactctacacatcaccagcctgccggctagaagtatttgactaattatactgtactaatatttaatcttactccgcttacgtacgtttcgggacggtaacgggaccctaaagggtcggaagtaacgttaaacgaaaacggtaacgttacggtcggacgtaacgacctaacctacgttccttaggttccctttactaaccg

SEQ ID NO: 351353 - DNA, 516 bp, Homo sapiens
  misc_feature: GZ8MTXP02GEESX.39.87.H10.1.454.CMB.2.raw
  modified_base (459)..(459): a, c, t, g, unknown or other
  misc_feature (459)..(459): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacaggcccctggacaaggcttgagtggatgggatggatacgaacggtaaccagtggtctacgaactaaattatgacacagtaagtttcgaggggcgagggtacaccatagaccgagggacacgtaccagtacaatacagacctacagtggaactgagacaggctagagatcgngacgacacggcatgtaattgtgtagcgagaagatagtagtactcttactacgttagg

SEQ ID NO: 351354 - DNA, 610 bp, Homo sapiens
  misc_feature: GZ8MTXP02JB94D.39.87.H10.1.454.CMB.2.raw
  modified_base (286)..(286): a, c, t, g, unknown or other
  misc_feature (286)..(286): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtggggcctcagtgaaggtctctgcaggcttctggaatcaccctcaccgacgtctatatgcatggttgcgacncggcccctggacaagggcttggagtggagtggggatggatacgaaacggtaaccaggtggtactacgaactaaaagtttacgtgacctaacgtaaggtaaacgttttcgaagggggtacgaacggggttaccaacccgaagttacggaacccgaaggggaacccgtaaccggttacccaattacgaaactaaccgacgtaccctaaacagtacggaacctggaacgacgacggcgtaggacgatcgtagacgacgtacggcgtagtaattagtggtcgacgtagagaagtcgacgttactcgtttactacgttacgtttagggg

SEQ ID NO: 351355 - DNA, 510 bp, Homo sapiens
  misc_feature: GZ8MTXP02FM3YA.39.87.H10.1.454.CMB.2.raw
  modified_base (359)..(359): a, c, t, g, unknown or other
  misc_feature (359)..(359): n is a, c, g, or t
  modified_base (480)..(480): a, c, t, g, unknown or other
  misc_feature (480)..(480): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggatgggatggatcgaaccggtaacagtggtctcaacaaattntgcacagtaagtttcgagggcagggtcaccatgacagggacacgtcatcaaatacagcctaacataggaactgagcgaggcgtgagatctagacgacgacggccgtagtattagttgacgngagaagagtagacgtactctactacttagg

SEQ ID NO: 351356 - DNA, 582 bp, Homo sapiens
  misc_feature: GZ8MTXP02G2IK3.39.87.H10.1.454.CMB.2.raw
  modified_base (342)..(342): a, c, t, g, unknown or other
  misc_feature (342)..(342): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttcgtggaatcaccctcaccgacgtctatatgcactggttgcgacacggcccctggaccaagggcttgagtggatgggatggatcgaacggtacngtgtctacactaaattgtgacacgagtaaagtttcgaggggtcaggggtcaaccgagtacgaccgagggacaccgtcaatcaaacgtacacgacctaacagtacggaactggagacgaggtcaggaacgacttcgacgaccgaaccgtaccgggtaccgttacgttagttacgtttggacggtacggaagaaggtaacgtaggtacgttactttacgtttaccgttaacgtttaacgggg

SEQ ID NO: 351357 - DNA, 536 bp, Homo sapiens
  misc_feature: GZ8MTXP02G7TSP.39.87.H10.1.454.CMB.2.raw
  modified_base (336)..(336): a, c, t, g, unknown or other
  misc_feature (336)..(336): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctctgcaaggcttcgtggaatcaccctcaccgacgtctatatgcagtggttgcgacacggcccctggacaaggctgagtggatgggatggatacgaaacggtanagtgtactcaataattgtgcacagtaacgttcgaggcagggtcaacgagtgacgagggacacgtacatacaatacacgctacataggaactgagacgaggctagagatcgtagacgacgacggtcgtagtatttacgtgacgtcgaagagacgtaagtacgttacttcgttacttacgtacggtttaggggtttaacggg

SEQ ID NO: 351358 - DNA, 559 bp, Homo sapiens
  misc_feature: GZ8MTXP02HXFQD.39.87.H10.1.454.CMB.2.raw
  modified_base (224)..(224): a, c, t, g, unknown or other
  misc_feature (224)..(224): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtgggcctnagtgaaggtctctgcaaggcttcgtggaatccaccctcaccgacgtctatatgctactggttgcgacacggcccctggacaaggcttgagtggagtgggatggatcgaacggtaaccagtgtacacaactaaattagtgacaacgtagtaagtttcagggtcagggtaccacagtacgaacgagggacacgtacagtacaaatacgagacctacataggaactgacgacgagtacaggataacgttcgaggacgaacgacgggtaccgttagttaactttagtgtacgacgaagagtaagtagtacgttactctttacgtactttaggtacgggg

SEQ ID NO: 351359 - DNA, 647 bp, Homo sapiens
  misc_feature: GZ8MTXP02FYIXP.39.87.H10.1.454.CMB.2.raw
  modified_base (247)..(247): a, c, t, g, unknown or other
  misc_feature (247)..(247): n is a, c, g, or t
  modified_base (358)..(358): a, c, t, g, unknown or other
  misc_feature (358)..(358): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaggtctctgcaggctngatcaccctcaccgacgtctatatgctactggttgcgacgacggcccctggacgaaggcttgaggtggagtgggatggatacgaacggtacagtggtctacaactaaattntgacaacaaggtagtttcgaaggggcgtaaggggtcaacccgtagtacggaacccgagggacaccgttaccgaactacaaaactaccgaaacgtaccctaacgtaacgttacggaaaccgtaggaacggaccgaagggtaccgttaggaacggtacgttacgtacggggaccgaaccggtaccgggtaccggtttaggtttaacgtttaacggtttcggtagggtaccggtaagggaaggttagtaggttaacgttaaccgtttctttaaccgttaacgtttaaagggg

SEQ ID NO: 351360 - DNA, 554 bp, Homo sapiens
  misc_feature: GZ8MTXP02FUXK5.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaaacggtaacagtcggtctacgactaaattatgcacagtaagttcagggcagggtcacatgaccagggacacgtaccatacaaactacacgcctaacacgtaggaaacctgagaccggacggacgtaggaagacgttaccgagaaccgacgacgggaccgtaggtatttaagttggtcgcgacgagagtaagtagtacgtacttactacttacgtaggtttaacgggg

SEQ ID NO: 351361 - DNA, 560 bp, Homo sapiens
  misc_feature: GZ8MTXP02FI888.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaatgatttagcctggtatcagcagaaaccaggaaaactcctaaggtcctgatctatgatgcctcagtttggaaagtgggtccatcaaggttccatcggcagtggatcgtggggacagtatttcactctcaccatcagcagcctgcagcctagaagtatttgactaacttactattgtacaaacaggtaccttaaacgtacggttttccccgaagggtaccgtttacggggacccgaaaagggggaccctaaaaggggttacgggaaaaactaccgaaaaacggaacttaggtcgggtactggacaccattctacgtcttctac

SEQ ID NO: 351362 - DNA, 598 bp, Homo sapiens
  misc_feature: GZ8MTXP02GRZLF.39.87.H10.1.454.CMB.2.raw
  modified_base (295)..(295): a, c, t, g, unknown or other
  misc_feature (295)..(295): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctgagtgaggtctcctgcaggcttctggatccacccctcaccgacgtctatatgcctacgtggttcgcgacncggcccctaggacgaagggtcttaggagtggagtgggatggatacgaaaccggtaacnggtggtactacgaactaaatttngacaacgtaagtagttacgagggtcaagggtccaaccgtagacgaccgaagggaaccaccgtaccctaagtaccaaaacgttaccaacgtaccctaaacgaagtacgggtaaacttaggaacgtaccgaagggctaggacgactacgtacgacgaccgacgggtccttaagtatttagtgacgtagagaagtatcggtaactactacttacgtactttaggg

SEQ ID NO: 351363 - DNA, 568 bp, Homo sapiens
  misc_feature: GZ8MTXP02GSMLV.39.87.H10.1.454.CMB.2.raw
  modified_base (200)..(200): a, c, t, g, unknown or other
  misc_feature (200)..(200): n is a, c, g, or t
  modified_base (416)..(416): a, c, t, g, unknown or other
  misc_feature (416)..(416): n is a, c, g, or t
  modified_base (537)..(537): a, c, t, g, unknown or other
  misc_feature (537)..(537): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctcctgtctgcatctgtagganacagagtcaccatcacttgccggcaagtcagggacaattaaaatgattagctagtatcagacaagaaaccaaggaaactcgtaagtcctagatctatgatcgcctacgtaggtttaggaaacggttcggggtacccatacccgaaaggttcaggcggactaggtggtacgtcgtaggggaactagtactttcaacttctacaaccataccaccgancccgtgccgactagaatatttagactaacttattactagtactaaactaatttacttcttacgtcctactcttacgttcggacggtaacggacgtaaggtcgaagtaactacaaaaccgtntagtggactcgaccacgtactctacgttacc

SEQ ID NO: 351364 - DNA, 626 bp, Homo sapiens
  misc_feature: GZ8MTXP02JQFET.39.87.H10.1.454.CMB.2.raw
  modified_base (219)..(219): a, c, t, g, unknown or other
  misc_feature (219)..(219): n is a, c, g, or t
  modified_base (296)..(296): a, c, t, g, unknown or other
  misc_feature (296)..(296): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagagacagagtcacatcacttgccggnaagtcagggacaattaaaatgattagcctggtatcagacaagaaaccaagggaaactccgtaaggtcctgatctatnagtcgtcctacgtagtttagggaaacggttcggggtacccctagtaccgtaaggttcccgaggtcggactaggtggatcgtgggacctagtactttcacgtctacaccataccaccgacgccgtcggccgtactagtaacggttatttcgaaccttaactttacgttacgtagtaacctaaacttaattttaaacttcgttaactccgtacttcgtacgttcgggacggtacgggacgtaacgggtgaacgtaaactacggtaaaaccgtagtcggtacggtacgtcgtacccgtaacccgtacgttctaccggtttccttacgtacccg

SEQ ID NO: 351365 - DNA, 604 bp, Homo sapiens
  misc_feature: GZ8MTXP02F9W8H.39.87.H10.1.454.CMB.2.raw
  modified_base (247)..(247): a, c, t, g, unknown or other
  misc_feature (247)..(247): n is a, c, g, or t
  modified_base (569)..(569): a, c, t, g, unknown or other
  misc_feature (569)..(569): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaggtctctgcaggctntgatcaccctcaccgacgtctatatgcactggtgcgacacggcccctggacagggcttggagtggagtgggatggatacgaaccggtaacaggtggtactacaactaaattgtcgactaagtaggtaagtttacgaggggcgtacgggtccaaccgtagtacggaaccgaaggggtacctaccggtaccaacgtactaaaacgtacgaacgtacctaacgtaagtacggaaacgtagggaacgccgagggtactagggaacgtacgtacggtacgaaccgaacgtaccggtacgttagttaagttacgtgtacggagtaagngtagtagtacgtacttcgttacgtacgtttaaggg

SEQ ID NO: 351366 - DNA, 545 bp, Homo sapiens
  misc_feature: GZ8MTXP02JPIV1.39.87.H10.1.454.CMB.2.raw
  modified_base (222)..(222): a, c, t, g, unknown or other
  misc_feature (222)..(222): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcaattaaaatgattagcctggtatcagacaagaaaccaggaaaactcctaaagctcctgatctatgctgcatcctagtttcgacgtaaaggtcggggtaccaagtccgtaaggttcagtcggacaggtcggatcgtagggactagtactttcgactctacacatcatcagcctgacacgcctagaacgttatttacgacttaacttactagttacgtacaaacgtaggtactaacgtacgtttaccgagtacggtcgacgaagggacaagggtacaaactacgaaacgacgtgtacgctacgacacctagtctc

SEQ ID NO: 351367 - DNA, 598 bp, Homo sapiens
  misc_feature: GZ8MTXP02JXKSO.39.87.H10.1.454.CMB.2.raw
  modified_base (242)..(242): a, c, t, g, unknown or other
  misc_feature (242)..(242): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggacaattaaaangtattagctgtatcagcaagaaaccagggaaacctcgtaaggtcctgatctatgatcgcctacgtaggtttaggaaggtcgggtacccagtacgtaaggttccagcggataggtggatcgtgggacagtcttacactcgtaccacactaccgaccagtcccgtgaccggtctaggtaagttattttacgactaaactttagtaacttgtaactaaacttaatttaacgttactttactcccgtactaccgttacgtttcgggacggtaaacgggaccgtaagggtacggaagtacctaaacgaaacggtacgtaggtcggacctgacctaaccagttcttcgttaccttacgtaac

SEQ ID NO: 351368 - DNA, 519 bp, Homo sapiens
  misc_feature: GZ8MTXP02FRC7X.39.87.H10.1.454.CMB.2.raw
  modified_base (358)..(358): a, c, t, g, unknown or other
  misc_feature (358)..(358): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggttgcgacacggcccctggacaagggctgagtggagtgggatggatcgaaccggtaacagtggtctacacaaattntgacacaagtaagtttcgaggggcaggggtcaccgatcgaaccagggacacgtcatacaatacagcctacatggaactgagcaggctgagatctagacgacacggtccgtgttaagttatagtcgacgaagaagagtgacgttactcttactactttaagg

SEQ ID NO: 351369 - DNA, 680 bp, Homo sapiens
  misc_feature: GZ8MTXP02G8WEP.39.87.H10.1.454.CMB.2.raw
  modified_base (597)..(597): a, c, t, g, unknown or other
  misc_feature (597)..(597): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttggaccgggtaatcgagggactaaattaaaatgtaatttagccttaggtatcgagacaacgaaaaccgaagggaaaacctccgtaaggtcctagatctatgactcgcctacgtaggtttagggaaaggtcgggtacccagtacgaaggttcacggcggactaggtcggtatcggtaggggactagttactttaccacttcctacacctactacccacgaccgtccgtcggcccgtactaggtaacgttacttttacgaacttaaactttacgttaactagttaacctaaactttaattttacttcgttaacgttccctactttaccgttacggtttcggggaaccgggtaaggtaacccggtaagggttacggaacgtttaanaaacccggtaaaaggtacgtcgggtacggtcttacggaacctaacccgttacttcgttacgttaccttacgtaccgtttcccg

SEQ ID NO: 351370 - DNA, 555 bp, Homo sapiens
  misc_feature: GZ8MTXP02FRJJA.39.87.H10.1.454.CMB.2.raw
  modified_base (286)..(286): a, c, t, g, unknown or other
  misc_feature (286)..(286): n is a, c, g, or t
  modified_base (356)..(356): a, c, t, g, unknown or other
  misc_feature (356)..(356): n is a, c, g, or t
  modified_base (505)..(505): a, c, t, g, unknown or other
  misc_feature (505)..(505): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggttncgacaggcccctggacaagggcttgagtggatgggatggatcgaacggtacagtggtctcaactaaattntgacaactagtaagtttcgaggggcaggggtcaccagtacgaccaggggaccacgtaccatacaaatcagacctacataggaactgagcgaggtctagagactcgagaccgacgacgggtccgttagttagtttaacgttcggttacgngaaggaagtattaggaacgtttaacttcgtttaccgttagtttaacgggg

SEQ ID NO: 351371 - DNA, 606 bp, Homo sapiens
  misc_feature: GZ8MTXP02FV8KT.39.87.H10.1.454.CMB.2.raw
  modified_base (353)..(353): a, c, t, g, unknown or other
  misc_feature (353)..(353): n is a, c, g, or t
  modified_base (373)..(373): a, c, t, g, unknown or other
  misc_feature (373)..(373): n is a, c, g, or t
  modified_base (469)..(469): a, c, t, g, unknown or other
  misc_feature (469)..(469): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtagaagaagccgtggggcctcgagtgaaggtctcctgcaaggcttcgtggaactccaccctcaccgacgtctatatgctacgtggtgcgacgacggcccctggacgagggtcttggagtggagtgggatggatacgaacggtanagtgtacacaactaaattgngacaacgtagtaacgtttacggagggacgagggtcaaccgagtacggaaccgaagggaccaccgtacaacgtacaaacgtacaacgtacccttaanacgtagggaaacctggaacgacgacggactaggaagtactacgacggaccgtaacggacgggtacgttagttaaattgttaggtacgacggagtaagtagttaggtaacgttacctttacttacgtacgtttagggg

SEQ ID NO: 351372 - DNA, 599 bp, Homo sapiens
  misc_feature: GZ8MTXP02IY6WT.39.87.H10.1.454.CMB.2.raw
  modified_base (252)..(252): a, c, t, g, unknown or other
  misc_feature (252)..(252): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagaagcctggggcctcagtgaaggtctcctgcaaggcttcnggaactcaccctcaccgacgtctatatgcactggttgcgacacggcccctggacaggtcttggagtggatgggatggatacgaaccggtacagtggtctacaacgtaaattgtcacacgagtaagttcgagggcaggggtaccaccgtagacgaccgaaggggacctaccgtacaataccaaatacacgacctaacgagttaggaacctggacgacgaggctagaacgtagtacgtacgaaccgaaaccgccgggtaccgttagttaacgtttaaggttcggtaggtaccgaaggtaacggtagttaggtaacggttaccttaccgtttacgttaccgtttaagggg

SEQ ID NO: 351373 - DNA, 622 bp, Homo sapiens
  misc_feature: GZ8MTXP02IZ2G7.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttggccgggcaaggtcgagggactaaattaaaatgtatttagcctaggtatcagacaagaaaccgaagggaaaacctccgtaaggtcctagatactatgatcgcctcgtagttaggaaaggtcgggtaccagtacgaaggttccaggcgacaggtggatcgtggggactagtatttcactctacaccactccaacccacgccctaggccgtaccgtaggtaaacgttacttttacgacttaaactttaacttacttagttaaactaaactttaaattttaacttactttaacgtccgtacttcctacggtttcggggaacggaacggtaaccgtaagggtcggaaactacgtaaaccgaaacgtacgtgtacgacgtcgactaacgtacttctacgttccttactaccg

SEQ ID NO: 351374 - DNA, 535 bp, Homo sapiens
  misc_feature: GZ8MTXP02F57YS.39.87.H10.1.454.CMB.2.raw
  modified_base (345)..(345): a, c, t, g, unknown or other
  misc_feature (345)..(345): n is a, c, g, or t
  modified_base (430)..(430): a, c, t, g, unknown or other
  misc_feature (430)..(430): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgaaggtctcctgcaaggcttctggaatccaccctcaccgacgtctatatgcactggtgcgacacggcccctggacaagggcttggagtggagtgggatggatacgaaccggtaacnggtggtctacaacaattatgacacagtaagtttcgagggcaggtcacagtcgaccgagggacacgtcagtacaatacacgcctanagtgaactgacgcgaggctaggantacgngacgacgaccggtcgtagttacttagttggtacgacgtagaagtagtagtacgtactcgtttacgtacgtttaagg

SEQ ID NO: 351375 - DNA, 547 bp, Homo sapiens
  misc_feature: GZ8MTXP02GELM2.39.87.H10.1.454.CMB.2.raw
  modified_base (247)..(247): a, c, t, g, unknown or other
  misc_feature (247)..(247): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagccgtggggcctcagtgaaggtctcctgcaaggcttcnggaatcaccctcaccgacgtctatatgcactggttgcgacacggcccctggacaagggtctgagtgatggatggatcgaacggtacngtgtcanaactaattngcacgaagtagttcgaggcagggtcacgatcgacgtaggacacgtacatcaacgtacacgacctaacgagtagacgtagacgtacgacgcgtagacgtatcgtagacgacgacggtccgtagtagttacgttggtacgacgagaagtagtggtaacgtacttacgttacgtaacgttaggttacgggtttaacgggg

SEQ ID NO: 351376 - DNA, 556 bp, Homo sapiens
  misc_feature: GZ8MTXP02HP7TC.39.87.H10.1.454.CMB.2.raw
  modified_base (389)..(389): a, c, t, g, unknown or other
  misc_feature (389)..(389): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggacaattaaaatgattagcctggtatcagcaagaaaccaggaaactcctaaggtcctgatctatgatgcctcgtagtttaggaaagtcggggtacccatccgaaggttcaggcggacaggtggatcgtagggacagtattcactctcacactcacngcctgcgctagtagtnttcgactaactttntacgtntaactaacttaatttacttacttactccgtcttacgtacgtttcgggacggtaacgggtaacgagggttacggaagtaacgtaccgaaacgtaacgtggtaacggctacgacctaccgtatcttacgttcc

SEQ ID NO: 351377 - DNA, 593 bp, Homo sapiens
  misc_feature: GZ8MTXP02JWAKS.39.87.H10.1.454.CMB.2.raw
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatccaccctcaccgacgtctatatgcactggttgcgacaggcccctggacaagggcttgagtggatgggatggatcgaaccggtaacaggtggtactacaactaaattgtgacaacgaagtaagtttacgaggggtcgaaggggtaccaccgagtacgaaccgtaacggggacaccgtccaattaccaacgtaacacgtacccttaacgacgtacggaaacgtaggaacgaccgagggtactaggaagataccgtagaaccgaccgaaccgggtccgtacggttattacgttagtcgtacgaggaagtagtaggtacgttactcttacgttacttaagg

SEQ ID NO: 351378 - DNA, 594 bp, Homo sapiens
  misc_feature: GZ8MTXP02JHKE9.39.87.H10.1.454.CMB.2.raw
  modified_base (247)..(247): a, c, t, g, unknown or other
  misc_feature (247)..(247): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtggggcctcgagtgaaggtctctgcaggctnggaatcaccctcaccgacgtctatatgcacgtggttcgcgacgacggccccgtggaccgaagggtcttggaggtggagtgggatggatacgaaaccggtacagtcgtactacaacgtaaatttgacgacaacgaggtaacgtttcgaaggggcgaacggggtcaaccgtagtacgaaccgaggggacaccggtaccaacgtacaaacgtacgacgtacctaacgacgttaggaaacgtggaacgccgaaggctaggaacgtctacgcgaacggtaccgacgggtaccgttagttattacgtcgtagacgagtaagtagtagtacgtacttcgtttactagtttaggg

SEQ ID NO: 351379 - DNA, 745 bp, Homo sapiens
  misc_feature: GZ8MTXP02G5KHD.39.87.H10.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccggnaagtcaggactataaaangtattagctgtatcagacaagaaccaggaaacctctaaggtcctagactctatgtaatcgaccttacgtaggtttacgggaaacgttcggggtacccctagtacccgtaaacgggtttcaacggtccgggtcgtaaggtgggtacgttccggtaagggggtaacctaacgggttacttttacgaaaccgtttcccttaacaaaccccgtaacttacccaaacccgtacggtcccgttacggcccgggtacccttaaggtaaacggttatttttacggaaaccttaaacgtttaaacgtttaccgttagtaaccgttaaaactttaaaccttttaacgttttaccttaactcccggttaaccttccgtttaaccgtttccgggggaacgggtaacgggttaacccggaaacgggttagggaacgtaacttaaaccggaaaaccggttaacggttgaacgggtcttaaccggacctaaacccgtttacgttacgttacgtttacg

SEQ ID NO: 351380 - DNA, 602 bp, Homo sapiens
  misc_feature: GZ8MTXP02HVV5K.39.87.H10.1.454.CMB.2.raw
  modified_base (374)..(374): a, c, t, g, unknown or other
  misc_feature (374)..(374): n is a, c, g, or t
  modified_base (466)..(466): a, c, t, g, unknown or other
  misc_feature (466)..(466): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcaggtccgggactgaggtgaagaagccgtggggcctcgagtgaaggtctcctgcaaggtcttcgtggaactcaccctcaccgacgtctatatgcacgtggtgcgacgacggcccctggaccgaaggcttggaggttggagtgggataggatcgaaacggtaacgagtgtactacaacaattntgacaacgtagtaaagtttcggagggtcgagggtacaccgagtcgaacccggagggacaccggtacaacgtacaaataccgagtaccctaanagttacgaacgtaggaacgcgaggacgtagacgtagtacgtacgaacggtacgaccgggttacgtacgttaagtttagtcgtacgtagtagtaagtagtagtacgttactttaccgttacctttaacgtttaaggg

SEQ ID NO: 351381 - DNA, 558 bp, Homo sapiens
  misc_feature: GZ8MTXP02IAT8D.39.87.H10.1.454.CMB.2.raw
  modified_base (395)..(395): a, c, t, g, unknown or other
  misc_feature (395)..(395): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcagaaaccagggaaaactcctaaaggtcctgatctatgatgcctcagtttggaaagtgggtaccatcaaggttccagcggcaggtgatcgtggggacagtatttcactctcaccatcaccagctgcgcctgaanatttgactaacttattactgtactaactaaatttaacttcttaatccgtacttctacgtttcggacgggtaacggaccgtaaagggtggtaagaactaaccgaaaaacggtaacctaggtacggtacgtaacgaccaacctacttccttagttcttactaacg

SEQ ID NO: 351382 - DNA, 569 bp, Homo sapiens
  misc_feature: GZ8MTXP02IU0MO.39.87.H10.1.454.CMB.2.raw
  modified_base (348)..(348): a, c, t, g, unknown or other
  misc_feature (348)..(348): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttctggaatccaccctcacccgacgtctatatgctacgtggttgccgacgacggcccccgtggacgaagggtcttgagtggatgggatggatcgaaggtaacngtgtctacactaattatgcactagagtttacgagggcgagggtcaccgatcgacgaggacacgtcatacaatacagcctacgatacggaactgacgacgagcgtagagtactcgtacgacgacgaccggtaccgttagttacttagttgttacggacgtaagtagagttggtaacgtacgtttacgttacgttaacgttaggttacggggttttaacgggg

SEQ ID NO: 351383 - DNA, 589 bp, Homo sapiens
  misc_feature: GZ8MTXP02F3JOU.39.87.H10.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (366)..(366): a, c, t, g, unknown or other
  misc_feature (366)..(366): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtgggcctnagtgaggtctctgcaggcttcnggaactccaccctcaccgacgtctatatgcacgtggttcgcgacgacggcccctaggacgaagggcttaggaggtggagtgggatggactacgaaacggtacaggtcgtctacaactaaattntgcacagtagtttcgagggtcagggtacacgtagtacgacgagggacacgtacagtacaaatacacgacctaacgagtaggaactgacgacgaggtactaggaacgtcgtacgacggaaccgacgtaccggtacgttagttagtttacgtcggggtacgacgtaaggcgtagtaacggtacttacgttacgttacgtaacgttaggttacggggtttaacggg

SEQ ID NO: 351384 - DNA, 699 bp, Homo sapiens
  misc_feature: GZ8MTXP02I3BDK.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtcctccatcctcctgtctgcatctgtaggagacagagtcaccatcacgttcggccgggacaaggtcgagggactaaattaaaaatgtaatttacgccgttaggtactacgaagacaaacggaaaaccgaaagggtaaaacctaccgtaaaggtcctagacttactatagactcgtccttacgtaaggtttaggaaacggttcgggtaccctagtaccgtaaggttcccgaggtccggacgtaggtaggacgttacgtgggggaactaggtactttaccacttactacaccactaccgaccctacgccgtggcccggtactaggtaaagtttctttacgaacttaaactttagtttaacctacgtttaaaccttaaaatttaaactttttaaactttacccttaacgtttcccggtacttaccgttaccggtttaccggggaacgggtaaacgggaacccgttaaaggggtacggaaagtacgtaaaacgaaacgttacgtggtcgactcgactacctgtcttctactctaccg

SEQ ID NO: 351385 - DNA, 565 bp, Homo sapiens
  misc_feature: GZ8MTXP02IMEFR.39.87.H10.1.454.CMB.2.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (329)..(329): a, c, t, g, unknown or other
  misc_feature (329)..(329): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagccgtgggcctnagtgagtctctgcagcttntgactcacctcaccgacgtcatatgcacgtggtncgacncggcccctggacagggtctgagtggatgggatggatcgaacgtangtgtctacaactaaattgtgacaacgaagttaaggtttcgaagggtcgaaggtcaccgatacgaccgtaagggactaccgtaccatacaaactacaacgtccctaaagacgttacggaactggaacgcgaaggtctaggaacgtatacgacggaacgacgtaccggtcgttagttagttacgttggtacgacgaagaagtacgtagtacgtactttccgttaacgtagtttacggg

SEQ ID NO: 351386 - DNA, 643 bp, Homo sapiens
  misc_feature: GZ8MTXP02F5AGH.39.87.H10.1.454.CMB.2.raw
  modified_base (253)..(253): a, c, t, g, unknown or other
  misc_feature (253)..(253): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtccgggactggaggtgaagaagccgtggggcctcagtgaaggtctcctgcaggcttcnggaatcgaccctcaccgacgtctatatgcatggtgccgacgacggcccctaggacaagggctgagtggagtgggatggactacgaaccggtacaggtcggtactacaaacgtaaattgtagactaacgtaggtaagtttccggaggggtaccgaggggttaccacccgaagtacggaacccgaggggaaccaccggtaacctacgtacaaaactacgaaacggacccttaaagaacgttaggaaactacgggtaacgaccgacgggtactaggaaggtcgtaaccgtaggaaccggtaaccggacggtaccggttagttaagtttacggttggtacgacgggaagtaagtagtacgtaacggttacttcgtttaccgtagtttaacgggg

SEQ ID NO: 351387 - DNA, 570 bp, Homo sapiens
  misc_feature: GZ8MTXP02HXGKD.39.87.H10.1.454.CMB.2.raw
  modified_base (247)..(247): a, c, t, g, unknown or other
  misc_feature (247)..(247): n is a, c, g, or t
  modified_base (387)..(387): a, c, t, g, unknown or other
  misc_feature (387)..(387): n is a, c, g, or t
  modified_base (450)..(450): a, c, t, g, unknown or other
  misc_feature (450)..(450): n is a, c, g, or t
tcagtcgcactagtcacgaccggtgctcgatttagcagtactgcgttgggtttgggggagcatcacccagcaaccacatctgtcctctagataatcccctgagagctccgttcctcaccatggactggacctggaggatcctcttcttggtggcagcagccacaggagcccatccccaggtgcagctggtgcagtccggactgaggtgaagagccgtgggcctcagtgaggtctctgcaaggcttcnggaatcaccctcaccgacgtctatatgcactggttgcgacgacggccccctaggaaccgaagggtccttaggaggtagggagtggggactaggatacgaaaccggtaacaggtggtactacaacgtaaatttgtgactanagtaagtttcgaagggtcagggtcacgatcgacgagggacacgtcagtacatacacgcctaanagtagaactggacgacgaggtacagacgagttacgagacgaacgacggtaccgtgttaaagttgttacgtagtacggagaagtagtacgtacgtacttaccgttacttacgtttaacggg

SEQ ID NO: 351388 - DNA, 584 bp, Homo sapiens
  misc_feature: GZ8MTXP02F9G0E.39.87.H10.1.454.CMB.2.raw
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggttgcgacacggcccctggacaagggcttgagtggagtgggagtagatacgaacgtacgagtcgtactacgaactaattgtgacaacgaagttaacgttacggagggacgtacgggtaccaacgtagtacgaaccggaacgggaaccaccggtaaccgtaactaccaaactaacgtaaccgtaccctaaagtaacgttacggaacttaggacgaccgaggtacgagaagatacgtacgacgacgacggtcgtagtattagtgtacgagtagaagtagagtacgtacttacttacgtagttagg

SEQ ID NO: 351389 - DNA, 514 bp, Homo sapiens
  misc_feature: GZ8MTXP02I2BBJ.39.87.H10.1.454.CMB.2.raw
  modified_base (353)..(353): a, c, t, g, unknown or other
  misc_feature (353)..(353): n is a, c, g, or t
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatccaccctcaccgacgtctatatgcactggttgcgacaggcccctggacaaggcttgagtggatgggatggatcgaaacggtacagtgtctcaactaaattangcacagtaagtttcagggcagggtcaccatgacgagggacacgtacatacaatacagcctanactggaactgagnaggctgagatactgacgacgacggtcgtgttattagttgtgacgtaagagatgagttactcttactactagttagggtttaacggg

SEQ ID NO: 351390 - DNA, 616 bp, Homo sapiens
  misc_feature: GZ8MTXP02G3PU7.39.87.H10.1.454.CMB.2.raw
  modified_base (363)..(363): a, c, t, g, unknown or other
  misc_feature (363)..(363): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccaatcccaggtgcagctggtgcagtccgggactgaggtgaagagcctggggcctcagtgaaggtctctgcaggctctggaatcaccctcaccgacgtctatatgcactggttgcgacacggcccctggacaaggcttggagtggatggggactggatacgaaacggtaaccaggtggtctacgaactaaagttanggtcaacgtaggtaaaagttttcccgaaggggtactagggggttacccaccgtacgttagaacccgaggggaaccctaccggtaccaacgtacaaactacgacgtaccctacaagtcggaactaggaacgaccgaggacctaggaaggtctacgtagacgacgtacgggtaccgtagttaacgttattacggtagtaccggagtaaggaagtagtaacgttactactttaccgtactttaggtttaacggggg

SEQ ID NO: 351391 - DNA, 584 bp, Homo sapiens
  misc_feature: GZ8MTXP02IY3GX.39.87.H10.1.454.CMB.2.raw
  modified_base (366)..(366): a, c, t, g, unknown or other
  misc_feature (366)..(366): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtgggcctcagtgaaggtctcctgcaaggcttctggaatccaccctcaccgacgtctatatgcacgtggttgcgacacggcccctaggacaagggcttggagtggagtgggatggatcgaaaccggtaacagtggtctacaacaaattntgacacagtaagtttcgagggcgagggtcaaccgagtacgaccgagggacaccgtacagtacaaactacacgacctaacagttagaactggaacgccgaggcgtaggaacgatacgtacgaacgaccgacggtccggttagttaagtttacgttcggtagaccggaagtaaggtagtaggtaacgttacctttaccgtttacgttaacgtttaagggg

SEQ ID NO: 351392 - DNA, 565 bp, Homo sapiens
  misc_feature: GZ8MTXP02F9IZM.39.87.H10.1.454.CMB.2.raw
  modified_base (223)..(223): a, c, t, g, unknown or other
  misc_feature (223)..(223): n is a, c, g, or t
  modified_base (335)..(335): a, c, t, g, unknown or other
  misc_feature (335)..(335): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccgggnaagtcagggcaattaaaaatgatttagcctggtatcagcaagaaaccagggaaactcctaaggtcctgatctatgatgcctcagttggaagtgggtccatcaaggtcagcgnagtgatcgtgggacagtatttcactctcacatcaccagcctgcgtccagaagtattttgactaacttattactgtactaaacttaaattttaacttcttaatcccgtacttaccgttaccgtttcgggacgggtacggggtaaccgtaaaggggttagaaagtaacgttaaaccgaaaacggtaacgtggtacggcttcggacctacctatccttcgttactttcctacc

SEQ ID NO: 351393 - DNA, 630 bp, Homo sapiens
  misc_feature: GZ8MTXP02FKOM5.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcgagtgaaggtctcctgcaaggtcttcgtggaactccaccctcaccgacgtctatatgctacgtggtgccgacgacggtcccctaggacgaagggtcttggagtggagtgggatggatacgaaccggtacagtcgtctacaactaaattgacgacaagtagtaagtttacggagggtacgagggtaccaaccgtagtacggaacccgaggggacctaccggtaccaagtaacaaactaccgaaccggaccctaacgacgtacgggaactaggacgtaccggaggtacgtaggaacgtacgtacgtacggaaccgtaccggtaccgggtaccgttacgttagtttacgtggtacgacggaagaagtagtacgtacgttaccttagttaccgtagtttaacgggg

SEQ ID NO: 351394 - DNA, 551 bp, Homo sapiens
  misc_feature: GZ8MTXP02IUKY8.39.87.H10.1.454.CMB.2.raw
  modified_base (364)..(364): a, c, t, g, unknown or other
  misc_feature (364)..(364): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatccaccctcaccgacgtctatatgcacgtggtgcgacaggcccctggaccaagggcttggagtggagtgggatgggatacgaacggtaaccagtggtctacactaaattngacacaggtaagtttcgagggacgagggtacacagtcgacgaaggacgacgtccataccaatacagacctacgataggaacgtgagcgagcgtagagatcgtagacgaaccgacggccgttaggtatttaagttcgtgacggtagaagtaagtagtagttactcgtttacttacgtagtttacgggg

SEQ ID NO: 351395 - DNA, 665 bp, Homo sapiens
  misc_feature: GZ8MTXP02G0XKP.39.87.H10.1.454.CMB.2.raw
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctgagtgaagtctcctgcaggcttnggaatccaccctcaccgacgtctatangcacgtggtgcgacgacggcccctggacgaagggtcttggagtggagtgggatggataccgaaacggtacagtggtctacgaactaaattagtcgactaacgaaggtaaacggtttacgaagggggtaccgagggggttaacccaaccgtaagtaccggaacccggaacggggaacccgtaaccggttaccaacgttacaaaacgttaccgaaccgtacctaaaccgagttaacggaacgttacggaacggtcggaacggtacgacggaacgtacgttcgaacgacggaaaccgcgggtacctaggttattaacgttggtacgaacggtagaacggtagtaaggtaacttacgttacgtttacccgtagtttaacgggttcgggtttaaacggg

SEQ ID NO: 351396 - DNA, 531 bp, Homo sapiens
  misc_feature: GZ8MTXP02G023L.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacacggcccctggacagggcttggagtggatgggatggatcgaaacggtaaccgaggtggtactacgaactaaattatgcagagtaagtttcgagggcagggtacacgatagacgaggacacgtcatacaatacagacctacagtacggaactgagcaggctaggagatcgtagaccgacgacggcgtagtacgttagtgtcgacgtagagtaagtgaacgtactactcgttactagtttagggg

SEQ ID NO: 351397 - DNA, 557 bp, Homo sapiens
  misc_feature: GZ8MTXP02JA1LO.39.87.H10.1.454.CMB.2.raw
tcagtcgcactagtcacgaccggtgctcgatttagcagtactgcgttgagtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcgagtgaaggtctcctgcaaggcttctggaatccaccctcaccgacgtctatatgcactggtgcgacacggcccctggacagggcttgagtggagtgggatggataccgaaacggtacagtggtctacaactaattatcgacaacagtaagtttcgagggtacgagggtacaccgagtacgaaccgtaggaccacgtaccgatacaacgtacacgacctaacagtaggactagaacgcgaaggcgtagacgatcgtacgacgacgaccggtccgtagttacgttacgttgtgtacgaagagtacgtagtacgttacgttcttacgtttaacg

SEQ ID NO: 351398 - DNA, 509 bp, Homo sapiens
  misc_feature: GZ8MTXP02I8TOC.39.87.H10.1.454.CMB.2.raw
  modified_base (223)..(223): a, c, t, g, unknown or other
  misc_feature (223)..(223): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (507)..(507): a, c, t, g, unknown or other
  misc_feature (507)..(507): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggcattaaaatgattagctgatcagcagaacaggaaactctaaggtctgatctatgatgcctctagtttggaagtgggtccatcaagttccagcgcagtgatcgtgggacagatttcatctacaccatcaccagcctgcgctgaacgttnttnactaacttatactatactaatatttacttactacgtccgtcttactacgttcggacggtacggacgtaaggtagagtactaacgaaacgtacgtcgtacgactcgactactctctacgtctacncg

SEQ ID NO: 351399 - DNA, 537 bp, Homo sapiens
  misc_feature: GZ8MTXP02IZ1BC.39.87.H10.1.454.CMB.2.raw
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (357)..(357): a, c, t, g, unknown or other
  misc_feature (357)..(357): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctgggcctnagtgaggtctctgcaggcttcgnggaatccaccctcaccgacgtctatatgcactggtgcgacgcggcccctggacaagggcttggagtggagtgggatggatcgaaacggtacagttcggtctacaacgtaaattnggcacgagtaaagtttcgaggggctagggtcacagtcgaccgagggacacgtacatacaatacacgcctagatggaactgagtgagctagagtatcgtagaacgacgacggtaccgttgtattacgtgtacgacgaagtagtagtgagttacctcgttactacgtagttggggttaacgg

SEQ ID NO: 351400 - DNA, 527 bp, Homo sapiens
  misc_feature: GZ8MTXP02F3QJU.39.87.H10.1.454.CMB.2.raw
  modified_base (363)..(363): a, c, t, g, unknown or other
  misc_feature (363)..(363): n is a, c, g, or t
  modified_base (434)..(434): a, c, t, g, unknown or other
  misc_feature (434)..(434): n is a, c, g, or t
  modified_base (460)..(460): a, c, t, g, unknown or other
  misc_feature (460)..(460): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgaaggtctcctgcaaggcttcgtggaatcaccctcaccgacgtctatatgcactggtgcgacacggcccctggacaagggcttgagtggagtgggatggatcgaaacggtacaggtggtctacgaactaaattntgacaacgaagtaagtttcaggggcagggtacacagtcgaccgaggacacgtacatacaatacagacctanagtagactggagccgagcgtagaganacgtagacgacgacgtcgtagtatnttganagagaagtagtagtacgtactacgtctaagtttaggg

SEQ ID NO: 351401 - DNA, 677 bp, Homo sapiens
  misc_feature: GZ8MTXP02GXR7P.39.87.H10.1.454.CMB.2.raw
  modified_base (251)..(251): a, c, t, g, unknown or other
  misc_feature (251)..(251): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttcnggaatcaccctcaccgacgtctatatgcactggtgcgacacggcccctggacaagggcttggagtggatgggatggatcgaaacggtacagtggtactacgaactaaattatgacaagtaacgtaagtttacgagggtacgaaggggtaccaacccgaagtacggaaccgaacggggaaccacccggttcccaaagttacccaaaagttaaccgaaacggtaccctaaaccgtaagttacgggaaaaccttagggaacgacccgagggaccgttaaggaagaacgtaccgtacgaaaacccggtaccggaaaccggggtcccggtttaagttaaacgttttaacggtttcgggtaggaccggaaggaaacggtacgtaggtaaacggttaacctttctttaacccgttaacggttttaaacggggg

SEQ ID NO: 351402 - DNA, 688 bp, Homo sapiens
  misc_feature: GZ8MTXP02GIV4J.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgaaggtctcctgcaggctcgtggaatcaccctcaccgacgtctatatgcactggttgcgacacggccccctagggaaccgaagggtcttggaggtggagtggggatgggatcgaaaccggtaacagttggtacttacgaaactaaagtttagcgtaccaaacgtaaggtaaacggtttacgaaggggtcgtaacgggggtaccaaacccgagtaacggacccgaaggggaacccaccggtacaactacaaaacttaccgaaacggtacccttaaacgacgttaacgggaaaccttagggaaacgacccgagggaccgttaggaaacgagtacccgtagggaaacccgtaacgaccgggtacccggttagttaaagtttaacggtttcggacggtacggaaggaaaggtagttaacggtaacgttaaccgttttccttacccgtttaacgtttaacgggg

SEQ ID NO: 351403 - DNA, 554 bp, Homo sapiens
  misc_feature: GZ8MTXP02H00PQ.39.87.H10.1.454.CMB.2.raw
  modified_base (429)..(429): a, c, t, g, unknown or other
  misc_feature (429)..(429): n is a, c, g, or t
  modified_base (495)..(495): a, c, t, g, unknown or other
  misc_feature (495)..(495): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcaattaaaatgatttagctggtatcagcaagaaaccaagggaaaactccgtaaaggtcctgatctatgatgcctacagtttggaaagtggggtacccagtcaaggttcccaggcggcaggtggattcgtggggactagtactttcactctcaccatcacagctcgcgtcaggtaatctttgactaactttattaccgtntactaaactaattttactcttaactccgtacttcgtacgtttcgggacggtacgggaccgtaaggnggttagaactacgaaaacgtcgtacgtggcctaagccacgtactcgttcttcttactcc

SEQ ID NO: 351404 - DNA, 566 bp, Homo sapiens
  misc_feature: GZ8MTXP02J2KIV.39.87.H10.1.454.CMB.2.raw
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcagtgaaggtctcctgcaaggcttctggaactcaccctcaccgacgtctatatgctacgtggttgcgacgacggcccctggacgaagggcttggagtggagtgggatggatcgaacggtacngtcggtctacgaactaaattntgacacgagtaagtttcgaaggggctaggggtcaccgagtcggaaccgaggggactaccgtaccaatacaactacgacgacctaacagtacggaacgtggacgcaggactggacgcgttacgacgacgacgacggtccgtagttacttagttcgcgacggtagaagtagtagacgttactcgttacgtacgttagg

SEQ ID NO: 351405 - DNA, 707 bp, Homo sapiens
  misc_feature: GZ8MTXP02G6CMI.39.87.H10.1.454.CMB.2.raw
  modified_base (245)..(245): a, c, t, g, unknown or other
  misc_feature (245)..(245): n is a, c, g, or t
  modified_base (367)..(367): a, c, t, g, unknown or other
  misc_feature (367)..(367): n is a, c, g, or t
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagcctgggcctcagtgaaggtctctgcaaggcttcgnggaatccaccctcacccgacgtctatatgcacgtggtgcgacacggtcccctaggacaaggtcttggagtgggagtgggatggatacggaacggtaacgagtcgtactacgactaaaagttntcgacaacgtagtaacgtttacgaacggggacgtacggggttaccaacccgtaagtacggaacccgaagggaacccgtaaccgttacccgtaaagttaccaaaacgttaaccgaacgtaaccccttaacgtaaacgtacgggtaaaccgtaggaacggtaccgtaacggaccgttaggaaacgtacgttaccgtaacggaaccggaacccggtaccggggtacccgttaggtttaaaccgtttaacggtttcggtacggtaaccggtaaggtaacggtaagtacggttaaacggttaccttaccgtttaaccgttaaccggtttaaggttttaacggggg

SEQ ID NO: 351406 - DNA, 728 bp, Homo sapiens
  misc_feature: GZ8MTXP02GGPSW.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcacgtgttgcgacaggcccctggacaggcttggagtggatggggatggatacgaacggtaaccagtggtctacaacgtaaaatttagcggacaacgtaaggtaaacgttttcgaaggggtacgtacggggtaccaacccgtaaggtacgaaccgaacggggaacctaccggtacccctaatacccgaaacttaaccgaacgtacccttaaccgaaagttacgggtaaaacccgttaggaacggtaccggaacggttaccgttaacgggaaggtacgttacggttaacggaacccggtaaacccggtaacccggggtacccggtttaaggtttaaaccgttttaaaggttaccgggttagggaacccggtaaggttaaaggtaacgttcgggttaaaccgtttaacgttaccgttttaaccgttaaccggttttaggttttaaacccgggggg

SEQ ID NO: 351407 - DNA, 525 bp, Homo sapiens
  misc_feature: GZ8MTXP02GSNS7.39.87.H10.1.454.CMB.2.raw
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
  modified_base (431)..(431): a, c, t, g, unknown or other
  misc_feature (431)..(431): n is a, c, g, or t
  modified_base (454)..(454): a, c, t, g, unknown or other
  misc_feature (454)..(454): n is a, c, g, or t
  modified_base (490)..(490): a, c, t, g, unknown or other
  misc_feature (490)..(490): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtcccgaagaagccgtggggcctcgagtgaaggtctcctgcaaggcttctggaatcacccctcaccgacgtctatatgcactggttgcgacaggccccctggacaagggcttgagtggatgggatggatcgaacggtacngtggtctacacaaattntgacacagtaagtttcgagggcagggtcaccatcgaccgagggacacgcaatacaatacagcctaanagtggaactgagcgagctagagntcgagacgacgacggccgtagttattagttgtacgngagaagagtagtacgtactcgttactacgtttagg

SEQ ID NO: 351408 - DNA, 508 bp, Homo sapiens
  misc_feature: GZ8MTXP02JNZRA.39.87.H10.1.454.CMB.2.raw
  modified_base (357)..(357): a, c, t, g, unknown or other
  misc_feature (357)..(357): n is a, c, g, or t
  modified_base (422)..(422): a, c, t, g, unknown or other
  misc_feature (422)..(422): n is a, c, g, or t
  modified_base (482)..(482): a, c, t, g, unknown or other
  misc_feature (482)..(482): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacagggcttgagtggatgggatggatcgaacggtaacagtggtctcaacaaattntgcacagtaagtttcgagggcagggtcaccatcgacgagggacacgtccatcaatacagcctaanagtagaaactgaagcgagcgtagaggatacgagacgacgacggccgtagtattattgcgngagaagatcgatatcttactattagg

SEQ ID NO: 351409 - DNA, 647 bp, Homo sapiens
  misc_feature: GZ8MTXP02IE88B.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttgtggaatcaccctcaccgacgtctatatgcagtggtgcgacgacggcccctggacagggtctgaggtggagtgggatggatacgaaacggtaacacgtggtactactaactaaattagtcgactaacgtaagttaaacgtttcgaacggggtcgaacgggttaccgaaaccgtacgtacggaacccgaacgggggtaacctaacccggtacctaaacgtacaaaacgtaccgacgaaccctaacagtaacggaactaggacgacgaaggtcgaggtacgactacgacgaccgacgtaccgggtccgttagttattacgttcggtacggacgtaaggtaagtacgtaaggtaacgtacctttacgttaactttacgttacggtttacggggtttaacgggg

SEQ ID NO: 351410 - DNA, 516 bp, Homo sapiens
  misc_feature: GZ8MTXP02ITG59.39.87.H10.1.454.CMB.2.raw
  modified_base (256)..(256): a, c, t, g, unknown or other
  misc_feature (256)..(256): n is a, c, g, or t
  modified_base (437)..(437): a, c, t, g, unknown or other
  misc_feature (437)..(437): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggcaattaaaatgattagctggtatcancaagaaaccaggaaaactcctaaggtcctagatctatgatcgcctcagtttggaagtcgggtaccatcgaaggtccagcggcagtgatcgtgggacagtatttcactctacacatcaccagcctgcgtactagaagtatttagactaacttatactgtactaataatttaatctatccgtnttcacgtttcggacggtaggaccaaggtcgaagactaacgaaacgtacgtcgtagctgaccactatctacgtctactac

SEQ ID NO: 351411 - DNA, 651 bp, Homo sapiens
  misc_feature: GZ8MTXP02G6JSO.39.87.H10.1.454.CMB.2.raw
  modified_base (250)..(250): a, c, t, g, unknown or other
  misc_feature (250)..(250): n is a, c, g, or t
  modified_base (342)..(342): a, c, t, g, unknown or other
  misc_feature (342)..(342): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtgggcctcagtgaaggtctctgcaggcttcgnggatcaccctcaccgacgtctatatgcactggtgcgacacggccctggacgaaggcgttgaggtggagtggggatggatacgaaccggtaanaggtcggtactacaacgtaaaattctaggcaaacgtagtaacggtttcgaggggactacggggtaccaaccgtagtacggaaaccggaggggaacctacccggtaccaacttacaaaattacccgaacggtaccctaaacgagttacggggaaaccttggaacggaccgacggtacgtaggaacgtagtaaccgtggaaaacccggaaccggtaccggggttaccgttagttaaacgtttagttacggtacggaagtaaggtaagaagttacggaacgtttacgtactttacgttaaacggttttgggg

SEQ ID NO: 351412 - DNA, 494 bp, Homo sapiens
  misc_feature: GZ8MTXP02H4IW7.39.87.H10.1.454.CMB.2.raw
  modified_base (334)..(334): a, c, t, g, unknown or other
  misc_feature (334)..(334): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (476)..(477): a, c, t, g, unknown or other
  misc_feature (476)..(477): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcagaaacaggaaaactctaaggtcctgatctatgatgctcagtttggaaagtgggtccatcaaggttccagcgnagtggatctggggacagatttcactctcaccaatcaccagccctgcgcctggaatatttgcaactttattactntacaanaaatttaaatcttaatcnctcactttcggacgagggacaaggtgagaananaaacacngtgnngcacactctctctactc

SEQ ID NO: 351413 - DNA, 609 bp, Homo sapiens
  misc_feature: GZ8MTXP02GUS73.39.87.H10.1.454.CMB.2.raw
  modified_base (253)..(253): a, c, t, g, unknown or other
  misc_feature (253)..(253): n is a, c, g, or t
  modified_base (497)..(497): a, c, t, g, unknown or other
  misc_feature (497)..(497): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttcnggaatcaccctcaccgacgtctatatgcacgtggttgccgacgtacggccccctagggaaccgaaggggtcttggagggttggagttggggattgggaacttacgaaacccgggtaacaggttcggtactacaactaaaatttgacggacaacgagtaagtttcgaaggggtcgaaggggtaccaaccgtatacggaaccgaaggggtaccaccggttaccaattacaaataccagaccctaanagtacgaactggagaccagggctagaagactagagacgacgacggtcgtagtattaagttcggacgaggagaagtagtaggtaacgtactttacttacgttaactttagggg

SEQ ID NO: 351414 - DNA, 558 bp, Homo sapiens
  misc_feature: GZ8MTXP02IABF1.39.87.H10.1.454.CMB.2.raw
  modified_base (366)..(366): a, c, t, g, unknown or other
  misc_feature (366)..(366): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcaccgacgtctatatgcactggttgcgacgacggcccctggaccaaggggcttggagtggagtgggatggatcgaacggtaacagtggtctacaactaaattntgacaacgagtaagtttcgagggcagggtcaccgatcgacgagggacacgtacatacaatacacgtacctaacacgtaggaactaggaacgacgacggatagaagattactaggaccgacgacgggtccgtagttaattacgttgagtacgaagaagtatacggtacgttaactcgtttacctagtttacgg

SEQ ID NO: 351415 - DNA, 603 bp, Homo sapiens
  misc_feature: GZ8MTXP02I3BL0.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttcgtggaatccaccctcaccgacgtctatatgcactggtgcgacgacggccccgtaggacgaagggtcttaggaggtggatgggatggatacgaaacggtacagtgtactacgaactaaattgtcgacaaacgtaaggtaacgtttcggaggggtacgacgggtaccaacccgagtacggaaccgaagggaccaccgtacaactacaaactacgacgacctaacgaacgttaggaactggaacgacgacggtacgtaggaagtacgtacgtacgaacgacgacggtccgtagttaattacgtagtacggacgtaagaagtagtagtacgtacgttacttactacgtttaaggg

SEQ ID NO: 351416 - DNA, 565 bp, Homo sapiens
  misc_feature: GZ8MTXP02F1PWW.39.87.H10.1.454.CMB.2.raw
  modified_base (466)..(466): a, c, t, g, unknown or other
  misc_feature (466)..(466): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaactcaccctcaccgacgtctatatgcactggtgcgacacggcccctggacaagggcttgagtggagtgggatggatacgaacggtaacagtggtctacaactaaattatcgacacaaggtaagtttcgaaggggtcaggggtaccaaccgatacgaaccgaaggggtaccacgtaccaatacaaatacagacctaacagtacggaactggacgngaacggctaggagtaactcgagacgacgacggtcgttagtagttagttggtagacgagtagaagtagacgttacttcgttactacgtaggtttacgggg

SEQ ID NO: 351417 - DNA, 579 bp, Homo sapiens
  misc_feature: GZ8MTXP02JLGSI.39.87.H10.1.454.CMB.2.raw
  modified_base (223)..(223): a, c, t, g, unknown or other
  misc_feature (223)..(223): n is a, c, g, or t
  modified_base (327)..(327): a, c, t, g, unknown or other
  misc_feature (327)..(327): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccgggnaagtcaggacaattaaaatgattagctgtatcagacaagaaaccaggaaactcgtaagtctagatctatgatgcctctagttggaagtgggtccatcagtcagngcagtgatgtgggatagtatttcactctacaccataccaaccacgtccgtgcccggactaggaattacgtttgacttaaactttattacgtagtactaaataattttaattcgttaactcccgtattccgtaacgtttccggggacggttaacgggaacctaaaggggttagggaactaacgttaaaccgaaaacggtaccgttaggtcggacttaacggacctaaccgtatccgttcttacttaccttccg

SEQ ID NO: 351418 - DNA, 521 bp, Homo sapiens
  misc_feature: GZ8MTXP02IVTG5.39.87.H10.1.454.CMB.2.raw
  modified_base (409)..(409): a, c, t, g, unknown or other
  misc_feature (409)..(409): n is a, c, g, or t
  modified_base (474)..(474): a, c, t, g, unknown or other
  misc_feature (474)..(474): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccgggcaagtcagggcataaaatgatttagctggtatcagcagaaaccaggaaaactcctaaggtcctagatctatgatgctcagtttggaagtgggtccatcaaggttccagcgcagtgatctggggacaggtatttcgactctcaccatccaccagcctgcggcctgaagtattttgctaaacttattactntactaacttaatttattacttaactccgtctactactttcggacggtagggaccaagggtagganacgtacaaaacggtactacgtggctgccaactctcctgtcttactac

SEQ ID NO: 351419 - DNA, 524 bp, Homo sapiens
  misc_feature: GZ8MTXP02IFBT4.39.87.H10.1.454.CMB.2.raw
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagatggtgcagtccgggactgaggtgaagaagcctggggcctcagtgaaggtctcctgcaaggcttctggaatcaccctcaccgacgtctatatgcactggtgcgacacggcccctggacaagggcttgagtggatgggatggatcgaacggtacngtggtctacacaattntgcacagtagtttcgaggggcagggtcaccatgaccgagggacacgtacatacaatacacgcctaacagtaggaactgagcgaggctgagattacgagaccgacgacggccgtaggttattagttcgtagcgtagaagtatgtacgtactctttactacgtttaaggg

SEQ ID NO: 351420 - DNA, 627 bp, Homo sapiens
  misc_feature: GZ8MTXP02FJGN1.39.87.H10.1.454.CMB.2.raw
  modified_base (372)..(372): a, c, t, g, unknown or other
  misc_feature (372)..(372): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagagccgtggggcctcagtgaaggtctcctgcaggctctggaatcaccctcaccgcgtctatatgcactggttgcgacacggccccctaggaccgaagggtcttggagtggagtggggatggatcgaaaccggtaccgtagtggtacttacaacgtaaatttnacgcaactagtaaagttttcgacggggtactaacggggtacaacccgaagtaccggaacccggaacggggaaccacccggttacccaaacgttacaaaaccttaccgacgaccccttaaacgacgttacgggaaccttagggaaagcccgaaggtccgtaggaaggtataccgtacggaacgaccgtaccgggtaccgtagtacgttacgttgtacggagagaagtagtacgtacttacttctacgttacgtagg

SEQ ID NO: 351421 - DNA, 528 bp, Homo sapiens
  misc_feature: GZ8MTXP02HWHJB.39.87.H10.1.454.CMB.2.raw
  modified_base (363)..(363): a, c, t, g, unknown or other
  misc_feature (363)..(363): n is a, c, g, or t
  modified_base (434)..(434): a, c, t, g, unknown or other
  misc_feature (434)..(434): n is a, c, g, or t
  modified_base (492)..(492): a, c, t, g, unknown or other
  misc_feature (492)..(492): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtgggcctcagtgaaggtctcctgcaaggcttctggaatcaccctcaccgacgtctatatgcactggttgcgacacggcccctggacaagggcttgagtggagtgggatggatacgaaaccggtaacagtggtactacacaaattntagacacgagtaagtttcgagggtcgagggtcaccgatgaccgagggacacgtacagtcaatacagcctanacgtagaactgagcgagcgtagagatctagacgacgacggtcgtagtattagtgtcgngagaagagtagacgtacgttacttcgttacgttagg

SEQ ID NO: 351422 - DNA, 614 bp, Homo sapiens
  misc_feature: GZ8MTXP02FMXEV.39.87.H10.1.454.CMB.2.raw
  modified_base (277)..(277): a, c, t, g, unknown or other
  misc_feature (277)..(277): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctgagtgaaggtctcctgcaggcttcgtggatcaccctcaccgacgtctatangctactggtcgacgacgacggcccccgtaggaccgaaggggtcgttggaggttgggagttcggggagtgggactacgaaccggtaactagtggtctacaactaaattgacgacaacgaagtaacgtttacggaacgggcgaacggggtcaaccgagtacgaaccgagggacacgtaccatacaaactacaacgtacctaagagtaggtaactagggaacgacgacggtacgtaggaggtactacgtacggaaccgaccgacgggtacgtaggttaactttagtacgtagacggaagaagtaagtagtaacgttacttacgttacgtacgtttaaggg

SEQ ID NO: 351423 - DNA, 637 bp, Homo sapiens
  misc_feature: GZ8MTXP02H0SLE.39.87.H10.1.454.CMB.2.raw
  modified_base (250)..(250): a, c, t, g, unknown or other
  misc_feature (250)..(250): n is a, c, g, or t
  modified_base (370)..(370): a, c, t, g, unknown or other
  misc_feature (370)..(370): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcagtgaaggtctctgcagcttcnggaatcaccctcaccgactctatatgcactggttgcgacgacggccccgtggacgaagggtcttggaggtggagtgggatggatacgaaacggtaacaggtgtactacgaactaaaattntgacaacgagtaagtttcgagggcgagggtacaacgagtacgaccgaagggacaccgtccaagtaaccaataacgaacgtaccctaacgtaacgttacggaaaccttagggaacgacgaacgggaccgtaaggaacgtaacgttcgtaaacggaccggtaccgaaaccggggtccgttaacgttaacgttaacgtttcggacggtaacggaaggaagtaacgtaggtaaacggttaaccttcgtttaaccgttaacgtttaaggggg

SEQ ID NO: 351424 - DNA, 602 bp, Homo sapiens
  misc_feature: GZ8MTXP02IFKDB.39.87.H10.1.454.CMB.2.raw
  modified_base (291)..(291): a, c, t, g, unknown or other
  misc_feature (291)..(291): n is a, c, g, or t
  modified_base (567)..(567): a, c, t, g, unknown or other
  misc_feature (567)..(567): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacnggcccctggacaagggcttgagtggatgggatggatacgaaccggtaaacaggtcggtctactaacgtaaaattcgtagcaaccgtaagtaaacgtttccgaaggggtaccgaaggggttaccgaacccgtaagtacggaaacccgaacggggtaaccgaaccggttacccagtaccaaagtaacacgtacccttaaaccgagtagggtaaccaggacgcgaaggcgtgaggtatacgtcgacgaacgacggccggtacgttagttaagttagtgngagaagagtagtagtactacttacttactttaagg

SEQ ID NO: 351425 - DNA, 586 bp, Homo sapiens
  misc_feature: GZ8MTXP02GDGAG.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcactggttgcgacacggcccctggacgaagggcttggagtggagtgggatggatacgaaccggtaacgagtggtactacgaactaaaatttgtacgacaactaaggtaaagtttacgaaggggacgtaaggggtaccaaccgagtacggaaccgaaggggaccaccggtacccaatacaaactaacaacgacctaacacgtagaactaggagccgagcgtagagtagtcgtagacgaacgacggtccgtagttagttattcggtagtcgaagaagagtgaacgttactacctttactacgtttaagg

SEQ ID NO: 351426 - DNA, 556 bp, Homo sapiens
  misc_feature: GZ8MTXP02FN0LM.39.87.H10.1.454.CMB.2.raw
  modified_base (344)..(344): a, c, t, g, unknown or other
  misc_feature (344)..(344): n is a, c, g, or t
  modified_base (387)..(387): a, c, t, g, unknown or other
  misc_feature (387)..(387): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccggcaagtcagggcattaaaatgattagcctggtatcagcagaaaccaggaaactcctaaggtcctgatctatgatgcctctagtttaggaaagtcggggtaccagtccgaaggttcagcgganaggtgatcgtagggacagtatttacactctacactatccaccngccctgccgctagaagtatttgactaacttattactgtactaaacttaatttactcgttactccgtactctacgtttcgggacggtaacgggtaccaaggggtcggaaacgtactacgaaaacgtacgttggtaacggtactcggacctacgtacttcgtagtttaccc

SEQ ID NO: 351427 - DNA, 554 bp, Homo sapiens
  misc_feature: GZ8MTXP02GB40Q.39.87.H10.1.454.CMB.2.raw
  modified_base (367)..(367): a, c, t, g, unknown or other
  misc_feature (367)..(367): n is a, c, g, or t
tcagtcgcactagtcacgaccggtgctcgatttagcagtactgcgttgggtttgggggagcatcacccagcaaccacatctgtcctctagagaatcccctgagagctcagttcctcaccatggactggacctggaggatcctcttcttggtggcagcagccacaggagcccactcccaggtgcagctggtgcagtccgggactgaggtgaagagccgtggggcctcagtgaaggtctcctgcaaggcttctggaatccaccctcaccgacgtctatatgcactggtgcgacacggcccctaggacgaagggcttggagtggagtgggatggataccgaaacggtacaggtggtactacaactaattntgacaacgtaagtaacgtttcgaggggtacaggggtacaccgagtacgaaccgagggaccacgtaccaatacaatacacgaccctagagtaggaaactgaacgcgagggcagaagtactacgacgaacgacgacggtacgtagtatttacgtcgtagagaagagagtagagttactcgttacttaag

SEQ ID NO: 351428 - DNA, 623 bp, Homo sapiens
  misc_feature: GZ8MTXP02HDJMF.39.87.H10.1.454.CMB.2.raw
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcaggtccgggactgaggtgaagaagccgtggggcctcagtgaggtctctgcaaggcttctggactccgaccctcaccgacgtctatatgcatggtgcgacacggcccctggacaagggctgaggtggagtgggatggactacgaaccggtaacngtggtcctanaacgtaaatttgcgacctaagtacgtaacgtttacgacgggggacgacgggtaccaccgaagtacggaacccgtaaggggacctaaccgtaccaactaacaaactaaccgacgtaccttaacagttagaacctagggaagcgaagggcgtaggagtacgtcgtaacgaccggaaccgtaccggggtaccgttagtacgtttagttcggtaggtacggaggaagtagtacggtaacgtactttaccgtttacgttaacgtttaagggg

SEQ ID NO: 351429 - DNA, 687 bp, Homo sapiens
  misc_feature: GZ8MTXP02JUGAJ.39.87.H10.1.454.CMB.2.raw
  modified_base (292)..(292): a, c, t, g, unknown or other
  misc_feature (292)..(292): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcaccgacgtctatatgcactggtgcgacncggcccctggacaagggtcttagaggtggatgggatggatcgaaacggtacagtgtctacaacaaattcgtgacacgtaagtaagtttcgaaggggtcaggggtacaaccgtaagtacggaaccgacggggaactaacccggtaccaagttaaccaaaacgtaaccaaacggtacccttaaacgtacgaaggggtaaacctaacgggaagaaccgtaacggggtaacgtacgggaacgtacgttacgtaaccggaaaccggtaacccggtaacccggggttacccgtttaaggtttaaacgtttacggtttacggtacgtaacggtaaggtaacggtaacgttaacggttaaacgtttaccctttaccgttttaaccgttaacggtttaaacggg

SEQ ID NO: 351430 - DNA, 605 bp, Homo sapiens
  misc_feature: GZ8MTXP02F8K8X.39.87.H10.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (306)..(306): a, c, t, g, unknown or other
  misc_feature (306)..(306): n is a, c, g, or t
tcagtcgcactagtcacgaccggtgctcgatttagcagtactgcgttggggtttggggggagtcagacccactcaggacacagcatggacatgagggtccccgctcagctcctggggcttctgctgctctggctcccaggtgccagatgtgccatccagttgacccagtctccatcctcctgtctgcatctgtaganacagagtcacatcacttgccggnaagtcaggactaattaaaangtatttagcctaggtatcagcaagaaaccgaaggaaaacctccgtaaggtcctagatctatgatcncctccgaaggtttaggaaaggttcggggtaccagtacgtaaggttccaggcggacgaggtggaacgtcgtggggacaggtacttacacttcacactatccacgagctgccgactaggaattactttagaacttaactttattactagttaacctaaatttaatttaacgttacttaactccgtacttacgttacgttacgggaacgggtacggaactaaggggtacgaaagtaacgtaaacgtaaacggtaacgtggtacggtactaacggacctactactcgtcttacttactacccg

SEQ ID NO: 351431 - DNA, 599 bp, Homo sapiens
  misc_feature: GZ8MTXP02GUALS.39.87.H10.1.454.CMB.2.raw
  modified_base (508)..(508): a, c, t, g, unknown or other
  misc_feature (508)..(508): n is a, c, g, or t
tcagtcgcactagtcacgaccggtgctcgatttagcagtactgcgttgggtttgggggagtcagacccactcaggacacagtatggacatgagggtccccgctcagctcctggggcttctgctgctctggctcccaggtgccagatgtgccatccagttgacccagtctccatccctccctgtctgcatcgtggtaggagacagagtccaccatcacttggccgggacaagtcgagggactaaattaaaatgtaatttagctggtatcagacaagaaaccgaaggaaactcgtaaggtcctgatctatgatcgcctacgtaggtttagggaaaggtcgggtaccagtacgtaaggttcacggcggactaggtggactcggtagggactagtactttccacttccacaacctactaccaccacggtccctcgggcccggtactaggtaacttagttttacgacttaaacgttattaacgtcttaaactaaacttaattttatacttacnccgtctacgtacggttcggaggaggtacgaggtgagtataacgaaacgtagtcgcgctagaaccactacgtctcgtcttacgtacttcccg

SEQ ID NO: 351432 - DNA, 663 bp, Homo sapiens
  misc_feature: GZ8MTXP02HDPX2.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttcgtggaatcaccctcaccgacgtctatatgcactggtgcgacacggcccctggacaggctgagtggagtgggatggatacgaacggtaaccaggtcggtactacgaactaaattagtcgacaacgtaaggtaaacgtttcgaacgggggtcgtaagggggttacccaaccgtagtacggaacccggaacgggggaaccctaaccggtacccaagttaaccgaaaacttaaccgaacgtaccctaaacgtaacgtacgggtaaacctggaacggacgaacgggccgtaggaaggtactcgtacgaaccggaaccgtacgggtacccgttaggttaacgtttagttacggtaggacggtaaggtaacggtaagtaggtaacgttaacctcgtttacgttaacgttaggttttacgggg

SEQ ID NO: 351433 - DNA, 249 bp, Homo sapiens
  misc_feature: GZ8MTXP02FRRCE.39.87.H10.1.454.CMB.2.raw
  modified_base (247)..(249): a, c, t, g, unknown or other
  misc_feature (247)..(249): n is a, c, g, or t
tcagtcgcactagtcacgaccggtgctcgatttagcagtactgcgttgggtttggggagttaataattggttcgaccctggggccaaggaacccaggtcaccgtctcctcagcctccaccaagggcccatcggtcttccccctggcaccctcctccaagagcacctctgggggcacagcggccctgggctgcctggtcaaggactacttccactagtgcgactgagcgggctggcaaggcgcatagnnn

SEQ ID NO: 351434 - DNA, 578 bp, Homo sapiens
  misc_feature: GZ8MTXP02H6PV2.39.87.H10.1.454.CMB.2.raw
  modified_base (344)..(344): a, c, t, g, unknown or other
  misc_feature (344)..(344): n is a, c, g, or t
  modified_base (470)..(470): a, c, t, g, unknown or other
  misc_feature (470)..(470): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcgagtgaaggtctcctgcaaggcttcgtggaaatccacccctcgacccacgtctatatgcacgtggttgcgacacggccccgtggacgaaggctgaggtggagtggatggatacgaacggtanagtggtctacaacgtaaattatgcactaagtaagtttcaggggtcgagggtccaccgagtagacccgaggaccacgtccatacaatacacgctaacatacggaaacttgagacgaggcctagagtntacgtgacgacgaccggtacgtagttaagttagttaggtacgtacggagtagaacgtggaacgtttactacctttacgttaaccgttaggttacgggtttaacggggg

SEQ ID NO: 351435 - DNA, 547 bp, Homo sapiens
  misc_feature: GZ8MTXP02GP3ZV.39.87.H10.1.454.CMB.2.raw
  modified_base (255)..(255): a, c, t, g, unknown or other
  misc_feature (255)..(255): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagaagccgtggggcctcgagtgaaggtctcctgcaggcttgnggaatcaccctcaccgactctatatgcacgtggtcgcgacgacggcccctggacgaagggtcttggagtggagtgggatggatacgaaccggtanaggtcgtacacaactaattngacacgagtagttcgagggcgacggtcacgagtcgacgaggacacgcatacatacacgtccaagagtagactaggacgacgagtcgtaggagtacgtcgtacgacgaccccgagggtctaggttattacgtggtcgacggagaagtagtacgacttactacttacgttaacgttggg

SEQ ID NO: 351436 - DNA, 567 bp, Homo sapiens
  misc_feature: GZ8MTXP02IAJ7N.39.87.H10.1.454.CMB.2.raw
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
  modified_base (426)..(426): a, c, t, g, unknown or other
  misc_feature (426)..(426): n is a, c, g, or t
tcagtcgcactagtcacgaccggtgctcgatttagcagtactgcgttgggtttgggatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagcctggggcctcagtgaaggtctcctgcaaggcttctggaatcaccctcaccgacgtctatatgcactggtgcgacaggcccctggacaagggcttgagtggatgggatggatcgaacggtaacngtggtctcaacaaattngcacagaaagtttcagggcagggtcaccatgaaccgagggacacgtccatcaaatacagctacatggaaactgaganagggctaggagatcgtaggacgacgacgggtaccgtgttaacgttaacgtttggaggaccgtaaggtaagaacgttaagggaacggttaaacgttcctttacttaacccgttaaacggtttcgggggtttaaaccgggggg

SEQ ID NO: 351437 - DNA, 746 bp, Homo sapiens
  misc_feature: GZ8MTXP02JGBQK.39.87.H10.1.454.CMB.2.raw
tcagtcgcactagtcacgaccggtgctcgatttagcagtactgcgttggggtttggggtagtcagacccactcaggacacagcatggacatgagggtccccgctcagctcctggggcttctgctgctctggctcccaggtgccagatgtgccatccagttcgacccagtcctccatccctccctgtctgcatctgtaggagacagagtcaccatcacgttggccgggacaagtcgagggactaaattaaaatgtatttagcctaggtatcagacaaagaaaccgagggaaaacctccgtaaaggtcctagactctatgactcgtcctaccgtaaggtttagggaaaggttcggggtacccaagtacgtaagggttcccgaagggtccgggtacgaagggttacgggacgttcggtacgggggaactaggtaacgttttacccgacttaccttaccaaccctactaccaacccgaacggtcccgttggcccgggttacctaagggtaaacgtttacgtttacgaaccttaaactttaacgttaaccgttacgttaaaccttaaaactttaaatttttaacttaccgtttaacctcccgttacttaccggttaacgggttaccggggaacgggtaaacgggtaaccggtaaagggtacggtaaacgtaaaccgtaaacggtaaaccggtacgtacggtacgtacgaacgtacctaaccgttagtccttacgtttacgttaccttaccg

SEQ ID NO: 351438 - DNA, 657 bp, Homo sapiens
  misc_feature: GZ8MTXP02IGTW9.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagcctggggcctcagtgaaggtctcctgcaaggcttctggaatcaccctcaccgacgtctatatgcactggtgcgacacggccccctggaacaagggcttaggagtggagtgggatggatacgaaacggtaaccaggtggtactacgaaactaaaattagtgactaaacaaggtaaacgtttacgaacggggactacggggtaccaaacccgtaagtacggaaccgaaggggaacctaaccggtacccaaacttacaaataccaacgtaccctaacaacgttaggtaaaccgtaggaacggaccgaaggccgttaaggaacgtagttacgtacgaacgaccgtacggaccggtttagtaacgtttaacgttacggtcgacggtaagaacggtaagtaggtaacttaccggttacgtttacccttaacgtttaacggtttaacggggg

SEQ ID NO: 351439 - DNA, 599 bp, Homo sapiens
  misc_feature: GZ8MTXP02I22RS.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggcaattaaaatgtattagcctggtatcagcaagaaaccaagggaaactccgtaaggtcctagatctatgatgcctcgtaggtttaggaacgttcggggtacccagtacgaaggttccaggcggcagtggattcgtggggacagtacttcgatctacacctatcaccacgcctggcccgctaggaacgttatttcgactaactttacttattgtacaagacggtcttaaacgtcgtttacccggagggttaccgttcgggaccgtaaaggggaccgtaagggtacgaaaacgttaccgaaaacgtaacgttggtacggtacctggaccaacctagtttcctacgttccttactccgtttaccgttcccccg

SEQ ID NO: 351440 - DNA, 522 bp, Homo sapiens
  misc_feature: GZ8MTXP02GG54V.39.87.H10.1.454.CMB.2.raw
  modified_base (423)..(423): a, c, t, g, unknown or other
  misc_feature (423)..(423): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcaggcattaaaatgatttagctggtatcagcagaaacaggaaaactcctaaggtcctgatctatgatgcctcagtttggaagtgggtccatcagttcagcgcagtgatcgtggggacagtattcactctcacatcacagcctgcgctgaagtattttgactaactttattactgtacaactaatttaattcttaanccgtctactaacgtttcgggacgaacggggtaaccaaggggtcggaaacgaataccgaaaacgtaacgtgtaggctgacacctatctcgtctttactac

SEQ ID NO: 351441 - DNA, 569 bp, Homo sapiens
  misc_feature: GZ8MTXP02HJOTW.39.87.H10.1.454.CMB.2.raw
  modified_base (226)..(226): a, c, t, g, unknown or other
  misc_feature (226)..(226): n is a, c, g, or t
  modified_base (363)..(363): a, c, t, g, unknown or other
  misc_feature (363)..(363): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctnagtgaaggtctcctgcaaggcttctggaatcaccctcaccgacgtctatatgcactggttgcgacacggcccctggacaagggcttggagtggatgggatggatcgaaccggtaacagtggtctacaactaaattgngacacagtaagtttacgagggtacaggggtcaaccgagtacgaaccgaggggaaccacggtaccagtacaactacacgaccttaacagttacgaacgtgaacgacgaggcgtaggacgactacgtacgaacggtacgacggtaccgtagttagttacgtggtcgacgagtaagagtacgtacgtacttcttacgtaccgtttaagg

SEQ ID NO: 351442 - DNA, 596 bp, Homo sapiens
  misc_feature: GZ8MTXP02I0XLL.39.87.H10.1.454.CMB.2.raw
  modified_base (378)..(378): a, c, t, g, unknown or other
  misc_feature (378)..(378): n is a, c, g, or t
  modified_base (445)..(445): a, c, t, g, unknown or other
  misc_feature (445)..(445): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcgagtgaaggtctcctgcgaaggtcttcgtaggaactccaccctcaccgacgtctatatgcacgtggtcgcgacgacggcccctggaacgagggtcttggaggtggagtgggatggatacgaaacggtaacgagtcgtactacaactaaattntgacaagtaagtaagttcgaagggacgagggtaccacgagtacgaccgaggacacgtccaatacaanacacgacctatagtaggaactaggacgacgaggcgtaggagtacgtcgtaggaaccgacgtaccgggtacgtttagttaacgttagttcggtacggacgtaggagtaagtcgtaacgttactacgtttacgttagttacggtttacggggg

SEQ ID NO: 351443 - DNA, 537 bp, Homo sapiens
  misc_feature: GZ8MTXP02JSCQU.39.87.H10.1.454.CMB.2.raw
  modified_base (432)..(432): a, c, t, g, unknown or other
  misc_feature (432)..(432): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtggggcctcagtgaaggtctcctgcaaggcttcgtggaatcaccctcaccgacgtctatatgcactggtgcgacacggcccctggacaagggcttgagtggatgggatggatcgaaacggtacacgtggtctacaactaaattatgcaacgaagtaagtttacgagggtacgagggtacaccgagtacgaccgagggacacgtcatcaatacagacctanatagaactgagcgagctagagatcgagacgacgacggtcgtagtattacgtgtgacgagagtagtaagacgttactcgttactacgttagtacgggtttaacggg

SEQ ID NO: 351444 - DNA, 521 bp, Homo sapiens
  misc_feature: GZ8MTXP02FRE02.39.87.H10.1.454.CMB.2.raw
  modified_base (423)..(423): a, c, t, g, unknown or other
  misc_feature (423)..(423): n is a, c, g, or t
  modified_base (454)..(454): a, c, t, g, unknown or other
  misc_feature (454)..(454): n is a, c, g, or t
  modified_base (488)..(488): a, c, t, g, unknown or other
  misc_feature (488)..(488): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaaacggtacagtggtctacgaacaaattatgcaacagtaaagtttcaggggcaggggtcaccatcgacgagggacacgtccatcaatacagcctaanataggaaactgaagcgaggctagacgatcgngacgacacggtacctgtatagttgtacgcgaagngatgagtactcttactactagtggtttaacggg

SEQ ID NO: 351445 - DNA, 652 bp, Homo sapiens
  misc_feature: GZ8MTXP02F8UC8.39.87.H10.1.454.CMB.2.raw
  modified_base (200)..(200): a, c, t, g, unknown or other
  misc_feature (200)..(200): n is a, c, g, or t
  modified_base (550)..(550): a, c, t, g, unknown or other
  misc_feature (550)..(550): n is a, c, g, or t
  modified_base (621)..(621): a, c, t, g, unknown or other
  misc_feature (621)..(621): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatccctcctgtctgcatctgtaganacagagtcaccatcacgttggccggcaagtcgagggactaaattaaaaatgtaatttagccgtaggtatcagacaacgaaaccgaaggaaaacctccgtaaggtcctagtatactatgatcgccctacgtaggtttaggaaacgtcgggtaccctagtcccgtaaggttccaggccggtagtaggtagggtactcgtaggggtaactagttactttccaaccttcctaccaactatacccacccgtagcccttaggccccggtcttaaggtaaacgttacttttacgaaacctttaaacctttattaaccgtattaaacttaaaactttaattttaaacttcgtttaacnccgttactacgttaacggttcggggaacggaacgggtaaccgaaggtcggaataacgtacgaaaaccggtntggtaagctacgcctaatcgtctacgtttcc

SEQ ID NO: 351446 - DNA, 573 bp, Homo sapiens
  misc_feature: GZ8MTXP02FTX1R.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggtgcgacacggcccctggacaaggctgagtggatgggatggatcaaacggtacagtggtctacaactaaattatcgcaacgagtaaacgtttacgaggggtacgaggggtcaccagtacgaacgaagggacaccgtacatacaaatacacgactacgaataggaactgacgacgaagcgtaggagtagtacgtaggaaccgacgaaccggtccgttagttaatttacggttagtggacgtaaggagtataaggtacgttacttctactttaacgtacgtttaggggtttaagggg

SEQ ID NO: 351447 - DNA, 620 bp, Homo sapiens
  misc_feature: GZ8MTXP02G328A.39.87.H10.1.454.CMB.2.raw
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
tcagtcgcactagtcacgaccggtgctcgatttagcagtactgcgttgggtttggggagtcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgagtctcctgcaggcttcnggaatccaccctcaccgacgtctanatgcactggtgcgacncggccccnggacgaagggtcttggagtggagtgggatggatacgaacggtaanaggtcgtcacgaactaaatttagngacgaacgttaaggtaacgtttacgaggggacgacggggtacaccgtagtacgaaccgacggggacctacggtacctacgtaacaactaaaccgaccgtaccgtaaacagttaacgggaacttaggggaacacgggtacgacgtagaacggtatcgtaacggacgacgtacggtaccgtgttagttagtggtcgacggtagaagtagtaagtaacggtacctttacttcttaacgttaggttcggggtttaaacgggg

SEQ ID NO: 351448 - DNA, 526 bp, Homo sapiens
  misc_feature: GZ8MTXP02HBMBA.39.87.H10.1.454.CMB.2.raw
  modified_base (420)..(420): a, c, t, g, unknown or other
  misc_feature (420)..(420): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcgagtgaaggtctcctgcaaggcttctggaatcaccctcaccgacgtctatatgcactggtgcgacacggcccctggacaagggcttgagtggatgggatggatcgaacggtacagtggtctacaactaaattatgcaacgagtaagtttcgagggtcagggtcaccatcgacagggacacgtcatcaatacagcctanataggactgagcgagcgtgagatcgtagacgacgacggtcgtagtagttagtgtacgacgagagtagtaaggtagtaactcttactacgttagttaggttaacggg

SEQ ID NO: 351449 - DNA, 635 bp, Homo sapiens
  misc_feature: GZ8MTXP02FTOWS.39.87.H10.1.454.CMB.2.raw
  modified_base (226)..(226): a, c, t, g, unknown or other
  misc_feature (226)..(226): n is a, c, g, or t
  modified_base (361)..(361): a, c, t, g, unknown or other
  misc_feature (361)..(361): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcacatcacttgccgggnaagtcagggacaattaaaatgtattagctggtatcagacaagaaaccgaaggaaactctaaggtcctagatctatgatcgcctcgtagtttaggaaacgtcggggtaccataccgaggttcaggcgacgaggtgngtcgtgggactagtattcactctacacactaccacgagtcccgtcggccggtaccgtagtaaacgttatttacgtaaccttaaactttagttaaccttacgttaacttaaaacttaaattttaaacttacctttaactacccgttactccgttaccgtttacggggaaccgggtaacggggaacccgtaaagggtacggtaaacgtaacgtaacgtaaaacggtaacgttggaacggtactacggacctacccgttataccgttacgtttaccg

SEQ ID NO: 351450 - DNA, 686 bp, Homo sapiens
  misc_feature: GZ8MTXP02IM7J8.39.87.H10.1.454.CMB.2.raw
  modified_base (219)..(219): a, c, t, g, unknown or other
  misc_feature (219)..(219): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcacatcacttgcggnagtcaggcaattaaaatgtattagctagtatcagcaagaaaccgaaggaaactccgtaaaggtcctagacttactatgatcgaccttccgtaaggtttagggaaacggttcggggtacccctaagttaccgtaacgggtttccaacgggccggtacgtaaggttacggtaacgttcgtagggggaacctaagggttactttttaccacccttctacctaaaccctactaccaacccgtagcccgtcggtacccggggtaccttaaggtaaacgttagtttttacgaaccttaacttttaacttacttagtaaacctaaactttaaattttaacttccttaactcccgtacttacgttaacggtttcgggaacgggtaacgggaacctaaggggtaggaaacacgttaaacgaaaaccggtagtacggtgactaacgacctacctacttctacgttacctactaaccc

SEQ ID NO: 351451 - DNA, 594 bp, Homo sapiens
  misc_feature: GZ8MTXP02HAGSA.39.87.H10.1.454.CMB.2.raw
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcacatcacttggccggnagtcagggcaattaaaatgattagctgtancagacaaaacgaggaaactcctaaggtcctgatctatgatcgcctcgtaggtttaggaaaggtcggggtacccagtcgaaggttccagtcggcgaggtaggatcggtagggacagttacttaccgactctactaacccatacccacacgccctggccgtacctaggaaacgttattttacgacttaaactttagtacctagttacctaaaacttattttaaacttccttaactccgtacttacgttacgttaccggggacgggacgggtaacctaaggggtggaacgaacgttaccgaaacgtacgtggtcgaactcgactacctatactcgttactac

SEQ ID NO: 351452 - DNA, 558 bp, Homo sapiens
  misc_feature: GZ8MTXP02IRUEQ.39.87.H10.1.454.CMB.2.raw
  modified_base (352)..(352): a, c, t, g, unknown or other
  misc_feature (352)..(352): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggccccctggacaaagggcttgagtgggatggggatggatacgaacggtacagtggtctcanaaattatgcacagtaagtttcgaggggcgagggtacacgatcgaaccgagggaacacgtaccatacgaatacacgtacctaacagtacggtaactggagaccgaggtcgaggaacgagtaccgtaggaacgacggtacggccgttagtaagttaagtgtacgacgagagtaatggtacgtactacgttactactaggtttacgggg

SEQ ID NO: 351453 - DNA, 535 bp, Homo sapiens
  misc_feature: GZ8MTXP02HMTN2.39.87.H10.1.454.CMB.2.raw
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtccgggactgaggtgaagagccgtggggcctcagtgaaggtctcctgcaggcttctggaatcaccctcaccgacgtctatatgctacgtggttgcgacacggcccctggacaggcttgagtggagtgggatggatacgaaccggtaacagtcgtctacaactaaattatgacagagtaagtttcgagggtcgagggtcacgtatacgaccgaggacacgtacaagtacaatacacgacctaacagtaggactagagcgagcgagagatcgtagacgacacggcgtagtattagtgtacgacggtagaagtagtagtacgtacttctacgttagtttaggg

SEQ ID NO: 351454 - DNA, 703 bp, Homo sapiens
  misc_feature: GZ8MTXP02IO7T5.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcgagtgaaggtctcctgcaggcttcgtggaactcacccctcaccgacgtctatatgaccacgtggtcgaccgtaccgacgggtcccccgtagggaaccgaaggggtcttaggacggttgggagtggggagtaggagtacggtaaacggtaccgtaggtcggtacctacgaacttaaaattagtacggacctaacgtaaaggtaacgtttacggaacggggtacgaacgggacccaacgaacgtacggaaccgacgggtaacccaaccggtacccaaattaaccgaaaacgttaaccgaacgtacccttaaacgtaagtacgggttaaacgaggacggaacgaacgggcttaaggagtacgtacgtaacgggacgaaccggtacgggtaccgttagttacgtttaagttcggtaggtaccgaggtacgtaagtacggttaagttaccttacttacgttaacgttgggtttaacggggg

SEQ ID NO: 351455 - DNA, 557 bp, Homo sapiens
  misc_feature: GZ8MTXP02ILWUJ.39.87.H10.1.454.CMB.2.raw
  modified_base (364)..(364): a, c, t, g, unknown or other
  misc_feature (364)..(364): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatccaccctcaccgacgtctatatcgctacgtggttgcgacacggcccctggacgagggtcttggagtggatgggatggatcgaacggtacaggtgtctcgaactaaattntgcaacgtagtagtttcgagggcagggtacaccgagtacgacccgaagggacacgtacatacaatacacgaccctaagacgtaggaactgaacgcgaggctggagattcgagacgacgacggtccgtaggttaattacgttggtacggacgtagaagtagtagtacgttacttacgtttactaacgtttaggg

SEQ ID NO: 351456 - DNA, 604 bp, Homo sapiens
  misc_feature: GZ8MTXP02GTKX5.39.87.H10.1.454.CMB.2.raw
  modified_base (288)..(288): a, c, t, g, unknown or other
  misc_feature (288)..(288): n is a, c, g, or t
  modified_base (319)..(319): a, c, t, g, unknown or other
  misc_feature (319)..(319): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcgagtgaaggtctcctgcaaggcttcgtggaatcaccctcaccgacgtctatatgcacgtggtcncgacgaccggcccccggagaacggtcttagngtggagtgggatggatacgaacggtaaacgtaggtacggtactaccgtaactaaaatttagtacgacacgagtaaacgggtttcggggacgagggtaccacacgtacgaaccgacggacaccgtacccaagtacaactacacgacctactagtacggaactaggagacgacggtacgagaagtacgtacgtagaacgacgacggtaccgtaggttacttagtggtacgagtagacgtactagtagtcctattacgtacgtagtacgggttacggtacgtttaaag

SEQ ID NO: 351457 - DNA, 537 bp, Homo sapiens
  misc_feature: GZ8MTXP02IVWOA.39.87.H10.1.454.CMB.2.raw
  modified_base (249)..(249): a, c, t, g, unknown or other
  misc_feature (249)..(249): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttcnggaatcaccctcaccgacgtctatatgccactggtgcgacacggcccctggacaaggcttggagtggatgggatggatacgaacggtaacctaggtcgtctacaactaaattatgcaacgagtaagtttccgaggggtcgagggtcacagtagaccgagggacacgtccagtacaaanacagacctaanagtaggactaggagacgaggctagagattcagacgacgacggtcgtagtattagtgtgacgagagaagtagacttactcttactacgtagtttacgggg

SEQ ID NO: 351458 - DNA, 550 bp, Homo sapiens
  misc_feature: GZ8MTXP02GRSCW.39.87.H10.1.454.CMB.2.raw
  modified_base (367)..(367): a, c, t, g, unknown or other
  misc_feature (367)..(367): n is a, c, g, or t
  modified_base (456)..(456): a, c, t, g, unknown or other
  misc_feature (456)..(456): n is a, c, g, or t
  modified_base (524)..(524): a, c, t, g, unknown or other
  misc_feature (524)..(524): n is a, c, g, or t
tcagtcgcactagtcacgaccggtgctcgatttagcagtactgcgttgagtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatccaccctcaccgacgtctatatgcacgtggttgcgacgacggcccctggacaagggcttggagtggagtgggatggataccgaaacggtacaggtggtactacaactaattnagacactaaggtaagtttcgaggggtacgaggggtcaccgagtacggacccgagggaccacggtaccatacaacgtacacgtacctaanagtacggaactgaacgcggaggacgtagaggactcgtacgacggacacggtcgtagtacttacgtcgngcgaagagcgtagatactcttactag

SEQ ID NO: 351459 - DNA, 515 bp, Homo sapiens
  misc_feature: GZ8MTXP02F2L61.39.87.H10.1.454.CMB.2.raw
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatggggatggatcgaaacggtaaccaggtggtactcgaactaaaattatgacacagaaagtttcaagggcagggtcaccatgaccagggacacgtccatcaatacagcctacataggaactgaagcaaggctagagatctgacgacgacggcgtagtattagtgtgcgagagaagtgagtactcttactactagttagggg

SEQ ID NO: 351460 - DNA, 569 bp, Homo sapiens
  misc_feature: GZ8MTXP02IPH0U.39.87.H10.1.454.CMB.2.raw
  modified_base (292)..(292): a, c, t, g, unknown or other
  misc_feature (292)..(292): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcgtcttcttggtggcagcagtcacaggacgcccagtccccaggtgaacttggtgcagtcgtgggtttgaggtgaagagccgtgggcctgagtgaacggtcccctgccaggtcttcgtggatacatcttcagcgcctattatatacactgggtncgccacggcccctggacaaggcctgagtggagtgggatgtatccgaacccgagacgtcggcgaacaacaaaatatacgctaacagagtactttacgagggacgacgggtacaccagtagacgtacggaaacgtcataacaaacagaccacatagaattanacgtanatagaacgtacaacgacgacggtcgtagtcgtacgtgcgtcgaggacgcgacgtacggtcctaggtaagggtaagtaacgtacggtacgtaacgtttacgtagttttaggg

SEQ ID NO: 351461 - DNA, 712 bp, Homo sapiens
  misc_feature: GZ8MTXP02JWJW6.39.87.H10.1.454.CMB.2.raw
  modified_base (371)..(371): a, c, t, g, unknown or other
  misc_feature (371)..(371): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttctggaatcaccctcaccgacgtctatatgcactggttgcgacacggcccctggacaagggcttggagtggagtgggatggatacgaaccggtaacaggtcggtactacgaactaaagttntacgactaacgtaagtaaagttttcgagggggtaccgaagggggttacccaaccgtaagttacggaacccggaaggggacctaacccggtccctaaagttaccaaaacttacccgaacggtaccccttaaacgacggtttaacggaaaccttagggaacggacgaacgggtaccgtaggaacgtacgttaccgtacggaaaccggtacccggtaaccgggggtcccgtttaggtttaacgtttacggttttaggacggggtaccggttaaaggaacggttaaggttacggtaaccggttttaaccttaccgttttaaccgttaaccgtttttaaacggggg

SEQ ID NO: 351462 - DNA, 604 bp, Homo sapiens
  misc_feature: GZ8MTXP02HBU3U.39.87.H10.1.454.CMB.2.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (472)..(472): a, c, t, g, unknown or other
  misc_feature (472)..(472): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccggactgaggtgaagaagccgtggggcctnagtgaaggtctctgcaaggcttnggatcaccctcaccgacgtctatatcgctacgtggttcgacgacacggtccccctaggaaccgaaggggtccttaggacgggttgggattggggatggaactacgaaaccgggtacaggtggtacctacgaaactaaattgacgacaacgtaagtacgtttcgagggtcgagggtccacgagtacgacgagggacaccgtacatacgaactacacgtaccanagtacgactagaacgacgaggtactagacgtacgtacgtagacgtacggaccggtacgttagttaacgttacgttcgacgtacggaagtaacgtagtacgtaacgtacctttacgtcgttaactttacgggg

SEQ ID NO: 351463 - DNA, 582 bp, Homo sapiens
  misc_feature: GZ8MTXP02HCSVR.39.87.H10.1.454.CMB.2.raw
  modified_base (252)..(252): a, c, t, g, unknown or other
  misc_feature (252)..(252): n is a, c, g, or t
  modified_base (449)..(449): a, c, t, g, unknown or other
  misc_feature (449)..(449): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcagtgaaggtctcctgcaaggtcttcgnggaatccaccctcaccgacgtctatatgcactggttgcgacgacggccccgtggaccgaagggcttgaggtggagtgggatggatacgaaacggtacaggtgtactacaataaattatagcaacgaagtaacgtttacgaaggggtcacggggtacaaccgtagtacgaaccgagggaacaccgttacactacaaanacgacgacctaaacagtaggaactggacacgaagctagagatcgacgacgacgacggaccgttagttattacgtggtagacgacgagacgtgaacgttacttacttacgtacttaggttacgggtttaacggg

SEQ ID NO: 351464 - DNA, 590 bp, Homo sapiens
  misc_feature: GZ8MTXP02IH5YC.39.87.H10.1.454.CMB.2.raw
  modified_base (288)..(288): a, c, t, g, unknown or other
  misc_feature (288)..(288): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtgggcctcagtgaaggtctctgcaaggcttcgtggaatcaccctcaaccgacgtctaatatgcactggttncgacacggcccctggacgaaggtctgagtggagtgggatggatacgaaaccggtaacgagtggtctacaactaaattgtcgactactagtaacgtttcgagggtaccgtagggtccaacccgtagtacgaacccgaaggggaccaacggtccaagtaccgaaactaacgacgtaccgtaacgacgtacggaactaggaacgcgaggcgttagagtaactcgtagaccgacgacggtccgtagtagttacgttgacgtacgagaagtacgtagacggttacttcgttacgtaacgtttaacgg

SEQ ID NO: 351465 - DNA, 561 bp, Homo sapiens
  misc_feature: GZ8MTXP02FO84J.39.87.H10.1.454.CMB.2.raw
  modified_base (361)..(361): a, c, t, g, unknown or other
  misc_feature (361)..(361): n is a, c, g, or t
  modified_base (433)..(433): a, c, t, g, unknown or other
  misc_feature (433)..(433): n is a, c, g, or t
  modified_base (518)..(518): a, c, t, g, unknown or other
  misc_feature (518)..(518): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggccccctggacaagggcttgagtggatgggatggatacgaacggtacagtggtctacaactaaattntgacacgagtaagtttcgaggggacagggtcaccagtacgacgagggacacgtcagtacaatacagcctaanataggaactgagcgaaggctaggaagtactacgtacggaacggtaaccgaccgggtaccgttaggttaatttaacgttcgtacgnggtaagaagtataggtacgtacttacttacctacgtttaaggg

SEQ ID NO: 351466 - DNA, 547 bp, Homo sapiens
  misc_feature: GZ8MTXP02GLWNC.39.87.H10.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (464)..(464): a, c, t, g, unknown or other
  misc_feature (464)..(464): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
  modified_base (529)..(529): a, c, t, g, unknown or other
  misc_feature (529)..(529): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaggcttcnggaatcaccctcaccgacgtctatatgcacgtggttgccganacggccccctggaaccaaggggtcttggaggtggagtgggatggatcgaaaccggtacagtggtctacaacgtaaattgtgccaagtagtaacgtttcgaggggcctaaggggtaccaacccagtacggaaccgaaggggaccaccggtaccaatacaaatacgaagcctanagtaggaacctggagcgagtcgagacgntcgagacgacncgacgtntatacgtgcgagagaaganagtactatactctacgtg

SEQ ID NO: 351467 - DNA, 653 bp, Homo sapiens
  misc_feature: GZ8MTXP02H8IDL.39.87.H10.1.454.CMB.2.raw
  modified_base (188)..(188): a, c, t, g, unknown or other
  misc_feature (188)..(188): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (599)..(599): a, c, t, g, unknown or other
  misc_feature (599)..(599): n is a, c, g, or t
tcagtcgcactagtcacgaccggtgctcgatttagcagtactgcgttgggtttggggatcacccagcaaccacatctgtcctctagagaatccccctgagagctccgttcctcaccatggactggacctggaggatcctcttcttggtggcagcagccacaggagcccactcccaggtgcagctggtncaggtccggactgaggtgaagaagccgtggggcctcaggtgaaggtctcctgcaaggtcttcgnggtaatccacccctnacccgacgtctatatgacctacgttggttcgaccggacgaaccggcccccgtagggaaccgaaacggggtccgtttggaaggttgggaagttggggaagtgggaactaaccggaaacgggtaactacggtcggtacctacaaacgtaaatttagtcgacaacgtaagtaagtttacgaagggacgacgtaccacccgtagacgacgtacggaaccacgtaccaagtaccaaagtaccacgtaccctaacacgtaacggtaaacttacggaacgaccgagggtcctaagggataacgtcgacgaccgacgacgggacctaggttactagttgngacgtagagtagtaagacgttacttcttaccgttacgtagtttacgggtaaggg

SEQ ID NO: 351468 - DNA, 657 bp, Homo sapiens
  misc_feature: GZ8MTXP02FWQ4K.39.87.H10.1.454.CMB.2.raw
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
tcagtcgcactagtcacgaccggtgctcgatttagcagtactgcgttgggtttgggggagcatcgcccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcaccgacgtctatatgcactggttgcgacgacggcccctggacaagggcttgagtggagtgggatggatcgaaaccggtanagtggtctacaacgtaaattgngacaacaagtaacgtttacgaggggcgaggggtaccaaccgtagtacgaccgaggggaaccaccggttaccaattacaaaacttaccgaacggtacccctaaacgaacgttacgggaaacccgttaggaacgacccgtaaggggaccgttagggaacgtacgttaccgtacggaccggaaacccgaccggggtaccgttaggttaaagtttacgttcgggttacggacggaaggaaggtagtaacggttaacggttactttaccgtttaccgttaacggttttaacggggg

SEQ ID NO: 351469 - DNA, 711 bp, Homo sapiens
  misc_feature: GZ8MTXP02GFJH3.39.87.H10.1.454.CMB.2.raw
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagaagccgtggggcctcgagtgaaggtctcctgcaaggtcttcgtaggaatccaccctcaccgacgtactatangcacgtggttgcgacncggcccnggacaaggcttggagtgggatggggataggatacgaaacggtaacacggtggtctacgaaactaaattatgacaacgtaagaagtttcgagggtacgacggggtacactagtcgaaccgaacggggactacggtaccaacttacaaactaacgacgtaacctaacgaacgtacgggtaaactcgggaacggtaccgaaccggggttacgagggttaacgaacgttaccggtaacggaaaccggggaaacccgaccggggttacccgggtttaaggtttaaacgttttaaacgttaggggttaaccggacgggtaaacggtaacgggttaaagttagggggttaaacgtttaacctttaccgtttaaccggtttaaaccgttaacggggtttttaaacgggggg

SEQ ID NO: 351470 - DNA, 502 bp, Homo sapiens
  misc_feature: GZ8MTXP02JAM98.39.87.H10.1.454.CMB.2.raw
  modified_base (341)..(341): a, c, t, g, unknown or other
  misc_feature (341)..(341): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacaggcccctggacaagggcttgagtggatgggatggatcaaacggtacagtgtctnacaaattatgcacagtaagtttcagggcaggggtcaccatgaccagggacacgtacatcaatacagcctaacataggaactgagcgaagctagagatactgacgacgacggccgtgtattatgtgcgagagatgagtactcttctactagtggtttacggg

SEQ ID NO: 351471 - DNA, 608 bp, Homo sapiens
  misc_feature: GZ8MTXP02IQSGE.39.87.H10.1.454.CMB.2.raw
  modified_base (226)..(226): a, c, t, g, unknown or other
  misc_feature (226)..(226): n is a, c, g, or t
  modified_base (549)..(549): a, c, t, g, unknown or other
  misc_feature (549)..(549): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgaccggnaagtcagggctaattaaaatgtaatttagcctggtatcagcaagaaaccaggaaaacctcgtaaggtcctagatctatgatcgacctcgtagtttaggaaaggtcgggtacctagtacgaaggttcaggcggacgtaggtggcgttcgtaggggactagttactttcgaactcctaccacacgtaccaccagtacccgtggcccgtacgtagtaacgtatttcgaacttaactttactaacgttataacctaaatttaaactttattacttacgttccgtacttacgtacgtttacgggacggtaacggaccgtaaagggtanaaggactaacgaaaacgtacgttaggtcggactcgacctacgtctttacctacgtttcc

SEQ ID NO: 351472 - DNA, 569 bp, Homo sapiens
  misc_feature: GZ8MTXP02H4TN9.39.87.H10.1.454.CMB.2.raw
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
  modified_base (327)..(327): a, c, t, g, unknown or other
  misc_feature (327)..(327): n is a, c, g, or t
  modified_base (344)..(344): a, c, t, g, unknown or other
  misc_feature (344)..(344): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctccaggtgccagatgtgccatccagttgacccagtctccatcctccctgtctgcatctgtaggagacagagtcaccatcacttgccgggnaagtcaggcaattaaaatgattagctgatcagcagaaacaggaaactctaagtctagatctangatgcctacagttaggaagtgggtaccagtcaaggtccagcgnagtgatcgtggactagntttcgactctacacactcacagtccagcgactgaagtacttgactaacttattactgtactaaactaatttaacttacttactaccgtcttacgtaacgtttccgggacggaacgggtaacccgtaaggggtttacggaagtaacttaacgaaaaacggtaaaccgttggtacggtacgttcggaacctacccgtaattccgtacggttaaccttttcgaacccg

SEQ ID NO: 351473 - DNA, 649 bp, Homo sapiens
  misc_feature: GZ8MTXP02JGYAS.39.87.H10.1.454.CMB.2.raw
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (408)..(408): a, c, t, g, unknown or other
  misc_feature (408)..(408): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacgaggacgcccactcccaggtgcagcgtggtgcgacggtccgggactggaggtagaagacgccgtggggcctcgaggtgaaggtctccgtgcgaggtctcgtggaactccaccctcaccgacgtctatagtgacctacgtggtcgaccgaacgccggccccgtaggaacgagggtctaggaggtggagtggatggatacgaacggtancgtgtacacaactatngcaagagtacgtgaggcacggtcacngtacgacgacggacacgtacatacgaaactcgaccgtacctaacgacgtaacggtaaccgtaggacgacggaacggtaccgtagggaacgtacgttacgacgggaaccgtacccggtaacccgggtacgtttaaggttacgtttagggttagggacggtacggaacggttagtaacggttaagttaaccgtttacttacccgtttaagtaaccggtttagggtttacgggggtttaaacgg

SEQ ID NO: 351474 - DNA, 592 bp, Homo sapiens
  misc_feature: GZ8MTXP02I7KWW.39.87.H10.1.454.CMB.2.raw
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (488)..(488): a, c, t, g, unknown or other
  misc_feature (488)..(488): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagaagccgtggggcctcagtgaaggtctcctgcaaggcttcnggaatcaccctcaccgacgtctatatgcactggttncgacacggcccctggacaagggcttgagtggatggggatggatacgaacgtagnggtgtcctanaaactaattgcacaacgtaagttacgttacggacgggtacgtacgggtaccaaccgtagtacgacggaacggaactaccgtacgaactacaactacgacgtacctaacgagtaagactaggacgcggacgtacgnggaaacgtcgttacgacggaaccgaacggtcggtacgttacgttagttacgttcggacgaggagtaaggtagtacgtacgttactacgttacgttaggttacgg

SEQ ID NO: 351475 - DNA, 630 bp, Homo sapiens
  misc_feature: GZ8MTXP02J48L9.39.87.H10.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
tcagtcgcactagtcacgaccggtgctcgatttagcagtactgcgttgggtttgggggcaggagtcagaccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcagggacattaaaacnattagtctgtagtcagacagaacacggaaacgactacgtacgtcgntctattntatctctcgtacgttaggtaaggtacgggtacgtacgtaccgtacgtacgtcgacggtcgacgtggtgtacgtcggtacgtacgtacgttacttactacccttacctaccacctaccaccgaccgtccgtcggtccggtaccgtacgttaacgttaacgtttacgttacgttaactttaccttacttacgttactaaccttacttaacttacttaactttacttaccgttacctccgtcgtacggtacggtacggtacgtacgggtacgggacgtaacgtacggaacggaacgtaacgtaacgtaacgtcgtacgtaccgtacgtacgtacg

SEQ ID NO: 351476 - DNA, 629 bp, Homo sapiens
  misc_feature: GZ8MTXP02IQNVX.39.87.H10.1.454.CMB.2.raw
  modified_base (378)..(378): a, c, t, g, unknown or other
  misc_feature (378)..(378): n is a, c, g, or t
  modified_base (535)..(535): a, c, t, g, unknown or other
  misc_feature (535)..(535): n is a, c, g, or t
tcagtcgcactagtcacgaccggtgctcgatttagcagtactgcgttgggtttgggggcatcacccagcaaccacatctgtcctctagagaatccactgagagctccgttcctcaccatggactggacctggaggatcctcttcttggtggcagcagccacaggagcccactcccaggtgcagctggtgcgaggtccgggactggaggtagaagaagccgtggggcctcgaggtgaaggtctccgtgacgaaggtcttcgtaggaactccaccctccgaaccgtacgtactatatgctacgtggttcgccgacgaccggccccgtaggacgaagggtcttaggaggtggagtgggagtggaactacgaacggtaacgngtcggtactacaaactaattgcgaactaacgtaagttaacgtttcgaacgggtacgaacggggtaccaaccgtagtaccggaacgaacggggaccacgtacaactacaaacgtacaacgtacctaagacgttagaactggacgacgaggctagaagntacgacgaacggacgtacggtacgtagttagttacgttggacgtaggaagtaagtcgtaacggtacgttcttacgtttacgtaacgtttagggg

SEQ ID NO: 351477 - DNA, 678 bp, Homo sapiens
  misc_feature: GZ8MTXP02G09V5.39.87.H10.1.454.CMB.2.raw
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatccctcctgtctgcatctgtaggagacagatcaccatcacttggccgggacaaggtcagggctaattaaaatgtattagcctggtatcagacaagaaaccgaaggaaactccgtaaggtcctgattctatgactcgccttacgtaggtttacggaaaggttcggggtaccctaagtacgtaaggttcccgaggtcggacgtaggtggtatcgtacgggggactagttacttccgtaccttctaccaaccctactcccaacccgagtcccgttacggcccggtaccttaggaaacgtttacgttttacgaccttaaacttttacgtttaccttaacggttacttaaaacttatttttaaactttcttaaccttccgtacttaccgtacggtttaccggggacgggtaaacgggaccgtaaaggggtcggaagtaaactaaccggtaaaacgtacgtcggtacggtactaaccggacaaccttattccgtactttcccttactaccc

SEQ ID NO: 351478 - DNA, 520 bp, Homo sapiens
  misc_feature: GZ8MTXP02FTAFK.39.87.H10.1.454.CMB.2.raw
  modified_base (241)..(241): a, c, t, g, unknown or other
  misc_feature (241)..(241): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaangatttagcctgtatcagcagaaaccaggaaactctaaggtcctgatctatgatgcctcagtttggaagtgggtccatcagtccagcgnagtggatctgggacagtnttcacttcncaccatcacgngcctgcgcngaattnttnactattatacgtntactaattatttacttctactccgtctacgtacgttcgggacggaaggacgtaaggtggataacgtaacgaaacgtacgttggacggtacgtcgtacgtactactacttcgttcttactacg

SEQ ID NO: 351479 - DNA, 620 bp, Homo sapiens
  misc_feature: GZ8MTXP02JZID4.39.87.H10.1.454.CMB.2.raw
  modified_base (252)..(252): a, c, t, g, unknown or other
  misc_feature (252)..(252): n is a, c, g, or t
  modified_base (364)..(364): a, c, t, g, unknown or other
  misc_feature (364)..(364): n is a, c, g, or t
  modified_base (466)..(466): a, c, t, g, unknown or other
  misc_feature (466)..(466): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctgagtgaaggtctcctgcaaggtcttcnggactcaccctcaccgacgttctatatgctacgtggtgcgacacggcccctggacgaggtctggagtggatgggatggatacgaacggtacagtggtactacgaactaattntgcaactaagtagttacgagggtcgagggtccaaccagtacgaaccgagggaccacggtccaacgtacaaacgtaccacgtacctaacgacgtacgggaacnggacggacgacggtacgtaaggtacgtacgtacgtacggaaccggtaccggtacggtaccggttagtacgtttacggtacggacggacggtaagtacggtaagtacggtacgtttacctttacgtttaccgttacggtttaacggttacggggg

SEQ ID NO: 351480 - DNA, 522 bp, Homo sapiens
  misc_feature: GZ8MTXP02I0WP4.39.87.H10.1.454.CMB.2.raw
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggatgggatggatcaacggtacngtgtctnacaattntgacacagagtttcgagggcaggtcacatagacagggacacgtacatacaatacacgcctacagtagaactgagcgagcgtgagatcgtacgacgacgacgggccgttaggtatttaacgttcgtaggtacgaggaagtacgtgacgttactcttacttaactttaggg

SEQ ID NO: 351481 - DNA, 578 bp, Homo sapiens
  misc_feature: GZ8MTXP02JHDK1.39.87.H10.1.454.CMB.2.raw
  modified_base (362)..(362): a, c, t, g, unknown or other
  misc_feature (362)..(362): n is a, c, g, or t
  modified_base (470)..(470): a, c, t, g, unknown or other
  misc_feature (470)..(470): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctctgcaaggcttctggaatcaccctcaccgacgtctatatgcactggttgcgacacggcccctggacaagggcttggagtggagtgggatggatacgaaccggtacaggtgtactcaactaaattntgacagagtaagtttcgagggtcgagggtcaccagtcgacgagggaccacgtccagtacaatacgactcctacagtaggaactaggagacgaggtaccgtaggaacgngttaccgtacggaaccggaccgtacgggtcccgttaagggttaatttaacgttggtacgtcggaaggaagtagtagtacgtaccttacgtttacgttactttaagggg

SEQ ID NO: 351482 - DNA, 538 bp, Homo sapiens
  misc_feature: GZ8MTXP02JLVQI.39.87.H10.1.454.CMB.2.raw
  modified_base (222)..(222): a, c, t, g, unknown or other
  misc_feature (222)..(222): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggnaagtcaggcattaaaatgattagctggatcagcagaaaccaggaaaactctaaggtcctgatctatgatgcctcagtttggaaagtcgggtccatcgaaggttccagtcgcagtgatctggggacagatttcactctcacatcacagctgcgctagagtatttgactaacttattactgtactaaactaattttaacttcttaatccgtactctacgtttcggacggtaacggacctaaggtacggaagtaaccgtagaaaaccgtaacgtggtacggcttaacgactaacctagttcctaggtcctttactaccg

SEQ ID NO: 351483 - DNA, 539 bp, Homo sapiens
  misc_feature: GZ8MTXP02IU94C.39.87.H10.1.454.CMB.2.raw
  modified_base (246)..(246): a, c, t, g, unknown or other
  misc_feature (246)..(246): n is a, c, g, or t
  modified_base (287)..(287): a, c, t, g, unknown or other
  misc_feature (287)..(287): n is a, c, g, or t
  modified_base (428)..(428): a, c, t, g, unknown or other
  misc_feature (428)..(428): n is a, c, g, or t
  modified_base (451)..(451): a, c, t, g, unknown or other
  misc_feature (451)..(451): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagagccgtggggcctcagtgagtctctgcagcttnggaatcaccctcaccgacgtctatatgcactggttgcgacncggcccctggacaggcttgagtggatgggatggatcgaaccggtacagtggtctacaactaaattgtgacaacgagtaagtttacgaggggtcaggggtcacgatcgacgagggacaccgtcagtacaatacgagacctanagtagaactgagcgagctgaagntacgtagacgacgacggtcgtagttaagttacgttcgtacgtacgagaagtagttacgtacgttacgttactttacgtacgtttaggg

SEQ ID NO: 351484 - DNA, 643 bp, Homo sapiens
  misc_feature: GZ8MTXP02H5P40.39.87.H10.1.454.CMB.2.raw
  modified_base (252)..(252): a, c, t, g, unknown or other
  misc_feature (252)..(252): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactccccaggtgcagctggtgcaggtccgggactgaggtgaagaagccgtggggcctcgagtgaggtctctgcaggcttnggaatcacctcaccgacgtctatatgcacgtggttgcgacgacggccccgtggacgaggtcgttgagtggagtgggatggataccgaacggtaacgagttcggtactacgtaaactaaatttgtgtacaaacgtaagtaaaggttttcggaacggggtacggtacggggttacaacccgtaagtacggaaccggaacggggtaacctaccggtaccaacgtaccaatacgacgacctaacgacgttaggaaactggaacgacgacggacgttagacgtacgtacgtacggaaccgaaccgtaccgggtccgttaggttacgttaacgttggtacgtacggagtaaggtacgtaggtacgttaaccttcgttacgtttaaccgtttaggggg

SEQ ID NO: 351485 - DNA, 616 bp, Homo sapiens
  misc_feature: GZ8MTXP02ITEVL.39.87.H10.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccgggnaagtcaggcaattaaaatgattagctggtatcagacaagaaaaccgaggaaaactccgtaaaggtctagatctatgactcgtcctaccgtaaggttttaggaaaggttcggggtaccctaatacgtaaggttccgacggcggtacgtaggtggtacgtcgtgggggaactaggtacttccactcactaccataccacgagccctggccgtactaggaaacttatttacgacttaaactttacttacttactaactaaacttaaattttacttacttacgtacctacgtacttaacggtttcgggacgggtaaagggtaaccgtaaggggttacggaaacgtaactacgaaaacgtacgtacgtcgctaacgactactactcgtcttctacttc

SEQ ID NO: 351486 - DNA, 648 bp, Homo sapiens
  misc_feature: GZ8MTXP02ISXRN.39.87.H10.1.454.CMB.2.raw
  modified_base (225)..(225): a, c, t, g, unknown or other
  misc_feature (225)..(225): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatccctccctgtctgcatctgtaggagacagatcacatcacttggccggnaagtcgagggacaattaaaatgtattagctggtatcagacaacgaaaccgaaggaaaacctccgtaaggtcctagatctatgactcgaccctcgtaaggtttcggaaaggtcgggtacccagtaccgtaaggttcacggcggacgaggtggagtcgagggtactagtacttacgacttcctaccacctactaccaccgacgtcccgtcggaccgtacgttagtaagttactttacgaacttaactttaattacctataccttaaactttaaacttttactttacctttaactccgtacttaccgtaccggtttcgggacgggtaacgggtaaccgtaaggggtacggaacgtaacgtaaaccgtaaaacggtacgttacgggtaacgtacgtacgtaccaacctacgttccttacggtttacc

SEQ ID NO: 351487 - DNA, 742 bp, Homo sapiens
  misc_feature: GZ8MTXP02ISG5L.39.87.H10.1.454.CMB.2.raw
  modified_base (222)..(222): a, c, t, g, unknown or other
  misc_feature (222)..(222): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttggccggnaagtcagggacaattaaaatgtattagcctggtatcagacaagaaaccgaagggaaaactccgtaaaggtcctagacttactatgaactcgtacctaccgtaagggtttagggaaaggttccggggtaccctaagtacgtaacgggtttacccgacgggaccggacgtagggtacggtagttccggtgggggaacctaggttactttacctacctctaccaaccctactacccgaacccgtacgcccgtaggacccgggtaccttaggtaaacgtttacgtttttacgaaccttaaactttttaacgtttaccgttaacggttaaacccttaaaacgtttaaacttttttaactttaacccgtttaaccgttccccggttacctttaccgttaacccggttttcgggggaaacccggggtaacggggtaacccgtaaaaggggtcggtaaaggtacttaaaccgaaaacgtacgttaggtacggtctaacgaccaccgtattcgtacgtttcttctaccg

SEQ ID NO: 351488 - DNA, 600 bp, Homo sapiens
  misc_feature: GZ8MTXP02FVUUP.39.87.H10.1.454.CMB.2.raw
  modified_base (250)..(250): a, c, t, g, unknown or other
  misc_feature (250)..(250): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttctggtggcagcagccacaggagcccactcccaggtgcagctggtgcagtccgggactgaggtgaagaagccgtggggcctcgagtgaaggtctcctgcaaggcttcnggaactcaccctcaccgacgtctactatgcactggtgcgacacggcccctggacaagggcttcgaggtgggatggggtagtggatacgaaacggtaaccaggtcggtactacaacgtaaattagtgacgaaactaaggtaagtttacgaaggggcgtacggggtaccaaccgagtacgaaccgacgggaactaccgtaccaatacaaatacaacgccaacagtaggaactgaacggcgaaagccgtagagacgttcgacggaacgaaccggaccgggtacgttagttacgttaagtttcgcgtacgagaagaagtgtaacgtactatttacgtaacgttggtttacgggg

SEQ ID NO: 351489 - DNA, 792 bp, Homo sapiens
  misc_feature: GZ8MTXP02HYLUP.39.87.H10.1.454.CMB.2.raw
  modified_base (230)..(230): a, c, t, g, unknown or other
  misc_feature (230)..(230): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatccctccctgtctgcatctagtaggagacagagtcaccatcacttcggccgganaagtcgagggactaaattaaaatgtattagcctaggtatcagacaagaaaccgaaggaaacctccgtaagtcctagacttactatgtactcgtccctacgttaggtttagggaaacggttccggggtacctaacgttaccgtaaagggtttacgacggtacggacgtaagggttcggtacgttcgggtaaggggtaacctaagggttaactttaccaaccttacctaccaacctactacccgaccgtacgtacccgttcgggaccccggtaaccttaaggtaaacgtttagttttaccgtaaaacctttaaaccttttaaactttaacccgttaacgtttaaacccttaaaacttttaaaactttttaaactttaccgtttaaacgttaccccgtttaacgttacccgtttaaacgggtttacccggggaacgggtaaaacggggaacccgtttaaaggggtacggtaaaacgtaaccgtaaaaccggtaaaaccgtaccggttaagggtccggtaccgttaacgacccgtaaaccttaacgtttccggtttacgttacccg

SEQ ID NO: 351490 - DNA, 587 bp, Homo sapiens
  misc_feature: GZ8MTXP02HZXMH.39.87.H10.1.454.CMB.2.raw
  modified_base (252)..(252): a, c, t, g, unknown or other
  misc_feature (252)..(252): n is a, c, g, or t
  modified_base (359)..(359): a, c, t, g, unknown or other
  misc_feature (359)..(359): n is a, c, g, or t
  modified_base (473)..(473): a, c, t, g, unknown or other
  misc_feature (473)..(473): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcgagtgaaggtctcctgcaaggcttcgnggaatccaccctcaccgacgtctatatgcagtggtgcgacacggcccctggacgaaggcttgagtggatggatggatacgaaggtacagtgtctacaactaattatnctacgaagtaagttcgaggggtcagggtaccacgagtacgacgacgggacacgtacagtacaaacgtacagacctaatacgtaaggaactaggacgtacgaggtcgagaacgtntacgtacggaacgacgtaccggtaccgttagttaacgtttagtcggtacggacgtaggtagtacgtaagtacgttacttacttacgtaacgtttaggttacggggtttaacggg

SEQ ID NO: 351491 - DNA, 782 bp, Homo sapiens
  misc_feature: GZ8MTXP02H0OGF.39.87.H10.1.454.CMB.2.raw
  modified_base (195)..(195): a, c, t, g, unknown or other
  misc_feature (195)..(195): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctccaggtgccagatgtgccatccagttgacccagtctccatcctcctgtctgcatctgtagganacagagtcaccatcacttgccgggcaagtcagggcaattaaaaatgaattagcctggtatcagacaagaaaccgagggtaaaacctcgtaaacggtcctaggtaactctagtgaagtcgaccttcgtaaaggttttagggaaaaggttggggtaacccctaagtacggtaaaacgggtttcccgaacggtcggtaccgaaggttggtaacgttccgttggggaaacctaaggtacttttacgaaccgtttaccaccttaaacccaacggttacccaaaaccccgtaccgtacccggtacggacccggttaaccgttaaacggttaaacgtttaacgtttaaccgtaaaccgtttaaaaccgttttaagttaaaccgtttacgttaaaacgtttaaaactttaaaattttaaccggttactttaacgtacccgtacttaaccggttaacgggtttaaccgggaacggggtaaacgggtaaacggtaaagggtaacggtaaagtaaacgtaaaaccggaaaacggttacgtacgttacggaccgttaacgacctaaacgttacgttacgtacgtttacctaccgttacg

SEQ ID NO: 351492 - DNA, 605 bp, Homo sapiens
  misc_feature: GZ8MTXP02IMWE7.39.87.H10.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (350)..(350): a, c, t, g, unknown or other
  misc_feature (350)..(350): n is a, c, g, or t
  modified_base (422)..(422): a, c, t, g, unknown or other
  misc_feature (422)..(422): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcgtgggcctnagtgaaggtctctgnaggcttcnggaatccaccctcacccgacgtctatatgctacgtggttgccgacgacggccccgtaggacgaagggcttaggaggtcggatggggatggaactacgaaacggtaanacggtcggtactacaaacgtaaattatagacaacgtaagtaaacgtttcgaaggggtcaagggtacacgtanacgaacgaggaacacgtacatacaaagtacacgacctacaagtaggaacgtgaagtaccgagacgtagaagtacgtcgacgaaccgtacgaaccgggtcgttagttacgttacgttggacgtacgaaaggtagtagtaagtagtacgttactacttacggttaggtttacggggtttaacggg

SEQ ID NO: 351493 - DNA, 560 bp, Homo sapiens
  misc_feature: GZ8MTXP02FWLTY.39.87.H10.1.454.CMB.2.raw
  modified_base (350)..(350): a, c, t, g, unknown or other
  misc_feature (350)..(350): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagcctggggcctcagtgaaggtctcctgcaaggcttcgtaggaactccaccctcaccgacgtctatatgctacgtggttcgcgtacgacggcccctggacgaagggcttaggagtggagtgggatggatcgaacggtangtggtctacaactaattctacacgtaagtagttacgtagggacgtacggtacgacacgtacgacgaacggacgacgtacgactacaactacacgacctactagtacgtacgtagacggacgacgacgtagagtactcgtagacgacgtacgcgtagtacttagtagtcgtacgagtagaagtgacgtactacgtactacgtagttacggg

SEQ ID NO: 351494 - DNA, 536 bp, Homo sapiens
  misc_feature: GZ8MTXP02I83MU.39.87.H10.1.454.CMB.2.raw
  modified_base (367)..(367): a, c, t, g, unknown or other
  misc_feature (367)..(367): n is a, c, g, or t
  modified_base (438)..(438): a, c, t, g, unknown or other
  misc_feature (438)..(438): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtccggactgaggtgaagagccgtgggcctcagtgaaggtctcctgcaggcttctggaatccaccctcaccgacgtctatatgcactggtgcgacacggcccctaggacaagggtcttggagtggagtgggatggatacgaaacggtaacagtacggtctacgaactaaattntgacaacgagtaagtttcgagggtcgaggtcacgagtcgacgtaggacacgtacatacaatacagacctanagtagaactgagcgagactagagatcgagacgacgacggcgtagtattagttcgcgtagagtaagatacgtacgtactacgtttacctagtttacggg

SEQ ID NO: 351495 - DNA, 593 bp, Homo sapiens
  misc_feature: GZ8MTXP02FN18U.39.87.H10.1.454.CMB.2.raw
  modified_base (197)..(197): a, c, t, g, unknown or other
  misc_feature (197)..(197): n is a, c, g, or t
  modified_base (368)..(368): a, c, t, g, unknown or other
  misc_feature (368)..(368): n is a, c, g, or t
  modified_base (399)..(399): a, c, t, g, unknown or other
  misc_feature (399)..(399): n is a, c, g, or t
  modified_base (419)..(419): a, c, t, g, unknown or other
  misc_feature (419)..(419): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganactgagtcaccatcacttgccgggcaagtcagggactaattaaaatgtaatttagcctggtatcagacaagaaaccagggaaaacctccgtaaaggtcctagatctatgatgcctcgtaggttaggaaaggtcggggtacccatacgaggttccgagcgcgagtggatcgnggggacaggtattccactctcacatccaccngcctgccgtcagtaaagttntttgactaacttacttactagttactaaacttaattttaacttacttactccgtacttcgtaacgtttcgggacggtaacgggaccgtaaggggtacgaagtacgtaaccgaaaacggtacgttacggcggtacctaagacctaacctattccgtacgttaccgtttctaaccg

SEQ ID NO: 351496 - DNA, 514 bp, Homo sapiens
  misc_feature: GZ8MTXP02JTQAJ.39.87.H10.1.454.CMB.2.raw
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (484)..(484): a, c, t, g, unknown or other
  misc_feature (484)..(484): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaaacggtaacagtggtctacgaactaaattatagcaacagtaaagtttcgaggggcagggtcaccagtgaccgagggacacgtaccatacaatacagctanatggaactgagcgagngtcgagagtcagacgcacgcgtagtatgtgtcgcgagagangagtactcttcacgttcgtaggtttacggg

SEQ ID NO: 351497 - DNA, 728 bp, Homo sapiens
  misc_feature: GZ8MTXP02FT69E.39.87.H10.1.454.CMB.2.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (260)..(260): a, c, t, g, unknown or other
  misc_feature (260)..(260): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttcgacccagtctccatcctcctgtctgcatctgtagganacagagtcaccatcacgttggccgganaagtcgaggactaaattaaaatgtattagctgtancagacgaagaaacgaaggaaactccgtaagtcctagatactatgatcgtccgtacgtaggttaggaaacggttcgggtaccctagtacgtaaggttccgacggtcggtacgtaggtaggtacgttacggtaggggaacctaggttaactttacccacttacctaccaccctaacgtacccaacccgtacgcccgtaggacccggtacgtaggttaaagtttacttttacgaacctttaaactttacttaaccgtagttaaaccttaaactttaaactttttaactttaccttaacccgttccgtacctttacggttaaccggtttacgggggaacggggtaacgggtaaaccgtaaaggggttacggaaacggttaaacgtaaaccggtaaaacggttacgttaggttaccggaccttaacggacccttaaccgttacttccgtttacgttacctttaccttaccccg

SEQ ID NO: 351498 - DNA, 785 bp, Homo sapiens
  misc_feature: GZ8MTXP02G70FI.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctcctgtctgcatctgtaggagacagagtcaccatcacttcggccgggacaaggtcgagggactaaattaaaagtgtaatttacgccgttggtactcagacgaacgaaaaccgacggtaaaactccgtaaaggtcctagactctataggactcgaccttacgtaagggtttaggaaacggttcggggtacctagtacgtaacggttccgaacggtcggactacgggtaggtaacgtcggtaggggaacttagtacgtttaccaccgttacctaccaaccctaactacccgaacccgtacgtccgtcgggacccggtacttaacggtaagtttaacgttttacgaacccttaaactttaagtttacccgttaaagttaaaccttaaaactttaaactttttaaccgtttaccctttaaacgtccccgttaactttaccggttaacgggtttaccgggggaaccggggtaaaacggggtaacccgggttaaaagggggttacggtaaaacgtaaacgttaaacccgtaaaacgggttacggttaacggtcgggtacctaaggtaccctaaccgtttacgttccgtttaccgtttaccgtacgtttaaccccg

SEQ ID NO: 351499 - DNA, 574 bp, Homo sapiens
  misc_feature: GZ8MTXP02F6CQT.39.87.H10.1.454.CMB.2.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctgggcctnagtgaggtctcctgcaggcttcnggatccaccctcaccgacgtctatatgcactggttgcgacacggcccctggacaagggcttggagtggagtgggatggatcgaaacggtacagtgtctacgaactaattntgacanagtaagtttcgagggcacgggtcacgagtacgaacaggggtacacgtaccaataccgaaatacgacgaccctaacgacgtaggaactagggaacgacgacggtacgtaggaacgtactaccgtaggaaccgacgtaccgggtccgttagttaacttagttcgtagtaccgagaacgtatacggtacgttactcctttacgtacgtttaggg

SEQ ID NO: 351500 - DNA, 657 bp, Homo sapiens
  misc_feature: GZ8MTXP02INFYK.39.87.H10.1.454.CMB.2.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
tcagtcgcactagtcacgaccggtgctcgatttagcagtactgcgttgggtttgggggcaggagtcagaccccactcaggacacagcatggacatgagggtcccccgctcagctcctggggcttctgctgctctggctcccaggtgccagatgtgccatccagttgacccagtctccatcctccctgtctgcatctgtagganacagagtcaccatcacgttgccggcagtcgagggactaattaaaatgtattagcgtaggtatacgagacaagaaaccgaagggtaaacctaccgtaagtacctagactactatgactcgtccctacgtagtttagggaaacggtcggggtacccagttaccgtaaggttccgaggcggacgtaggttcggngtcgtagggactagtactttcacttccaccaacctactacccaccgacgtcccgtcggccggtactaacggtaagttactttacggaaactttaacgtttattaccgtttataacttaaactttaaactttaatttaccgtttactaccgtaccttacttaccgggttacggacgggtaacggacgtagggggtactaaacggtacaaccgaaaacgtaggttacgaacggcttacggaccctacgtacttcggttactttcc

SEQ ID NO: 351501 - DNA, 589 bp, Homo sapiens
  misc_feature: GZ8MTXP02IHX17.39.87.H10.1.454.CMB.2.raw
  modified_base (459)..(459): a, c, t, g, unknown or other
  misc_feature (459)..(459): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcaggtccgggactgaggtgaagagcctggggcctcagtgaaggtctcctgcaaggcttctggaatcaccctcaccgacgtctatatgcactggttgcgacgacggcccctggacaagggcttgagtggagtgggatggtatcgaaaccggtaacgaggttggtacctacaaacctaaaatttgtacgacaacgtagtaacgtttcgaggggcagggtacaccgtagtcgaaccgagggacaccgtacatacaataccagaccctaanagtagaacgtagacgcgaggctagaacgtagtcgtagaaccggacgtaaccgggccgttagttaacgttacggttcgtaggacgtagaagtagtacgtacggttactaccgtttacgtaacgtttacggg

SEQ ID NO: 351502 - DNA, 520 bp, Homo sapiens
  misc_feature: GZ8MTXP02HCF7Y.39.87.H10.1.454.CMB.2.raw
  modified_base (251)..(251): a, c, t, g, unknown or other
  misc_feature (251)..(251): n is a, c, g, or t
  modified_base (286)..(286): a, c, t, g, unknown or other
  misc_feature (286)..(286): n is a, c, g, or t
  modified_base (361)..(361): a, c, t, g, unknown or other
  misc_feature (361)..(361): n is a, c, g, or t
  modified_base (423)..(423): a, c, t, g, unknown or other
  misc_feature (423)..(423): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtgggcctcgagtgaaggtctcctgcaaggcttcnggaatcaccctcaccgacgtctatatgcactggtncgacacggcccctggacaagggcttggagtggagtgggatggatcgaaccggtaacagtggtactcaacaaattntgacacagtaagttcgagggcaggtcaaccatcgacgaggacacgtcatcaatacagcctanagtagactagagcgagctagacgtatacgtagacgacgtacggccgttagtatttaagtgtacgagagaagatagacgtactcttactacgttaggg

SEQ ID NO: 351503 - DNA, 566 bp, Homo sapiens
  misc_feature: GZ8MTXP02I2E13.39.87.H10.1.454.CMB.2.raw
  modified_base (299)..(299): a, c, t, g, unknown or other
  misc_feature (299)..(299): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (409)..(409): a, c, t, g, unknown or other
  misc_feature (409)..(409): n is a, c, g, or t
  modified_base (438)..(438): a, c, t, g, unknown or other
  misc_feature (438)..(438): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctgggcctcagtgaaggtctcctgcaggcttctggaatcaccctcaccgacgtctatatgcacgtggttgcgacacggccccnggacaagggcttgaggtggagtgggatggatacaaccggtaacagtggtactcaactaaattntgacanagtaagtttcgagggcagggtcaccagtcgaccgagggacnccgtacaacgtacaactacagtccctaanacgtagggaactgggaacgccgaaggctacggagtactcgtagacggacgaccggtccggtagttagttagtaggtcgacggtagaagtagttcggtacgtacgtttccgtttactaaacgtttgggg

SEQ ID NO: 351504 - DNA, 644 bp, Homo sapiens
  misc_feature: GZ8MTXP02JG1IQ.39.87.H10.1.454.CMB.2.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtcctccatccctccctgtctgcatctgtagganacagagtcaccatccacttcggccggnaaggtcaagggactaaagttaaaaatgtatttagcctggtatcagacaaacgaaaccgaagggtaaaacctccgttaaaggcctagatctatgatcgcctacgtagtttagggaaacgtcgggtaccctagtaccccgtaaggttcgacgcggtcgtaaggttggacgtcgacgggacgtagttactttccgacctcctaccacctacacccaccgtagcccgtagccggtacttaagtaagttactttcgaaacttaaactttacttaaactcgtaactaaaattaaatttttacgttccttaattcccgactttaccgtacgttacgggcgggtaaacggacctaggggtacggataaacgtacccgaaaaggtcgttcgcggtctacggaactcgtacttcgtactttacc

SEQ ID NO: 351505 - DNA, 737 bp, Homo sapiens
  misc_feature: GZ8MTXP02H648H.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcaggtccgggactggaggtgaagaagccgtgggcctcgagtgaggtctcctgcaaggtcttgtggaactccaccctcaccgacgtctatatgctacgtggttgcgacgacggccccgtagggaaccgaagggtctttaggaggtgggtagtggggatagggactacgaaacggtaacgacggtcgggtacctacgaaacttaaaactttgtacgaacctacgtaaagggttaaacgtttcggaaggggtcaaacggggttccaaccgtagtacggaaacccggacggggtaaacctaccgttaaccactaaccgtaaactaccaacggtacccttaaacgacggttacgggaaaacctgggaaacgccggtaaagggccttaagggaactacgtaccgtacggaaaacccgaaccgggtacgggttacccgggttactttaaacggtttaagtttcggggtacggaacggtaagtaaacggtacggggttaacttaaacggtttaccctttacggttttaacgtttaaacggttttaaccggggg

SEQ ID NO: 351506 - DNA, 571 bp, Homo sapiens
  misc_feature: GZ8MTXP02JTNJ7.39.87.H10.1.454.CMB.2.raw
  modified_base (256)..(256): a, c, t, g, unknown or other
  misc_feature (256)..(256): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
  modified_base (473)..(473): a, c, t, g, unknown or other
  misc_feature (473)..(473): n is a, c, g, or t
tcagtcgcactagtcacgaccggtgctcgatttagcagtactgcgttgggtttgggggcatcacccagcaaccacatctgtcctctagagaatccccctgagagctccgttcctcaccatggactggacctggaggatcctcttcttggtggcagcagccacaggagcccactcccaggtgcagctggtgcaggtccgggactggaggtgaagaagccgtggggcctcgagtgaaggtctcctgcaaggtcttcgnggaactccaccctcaccgacgtctatatgcacgtggtgcgacgcggcccctggacgaggcttggaggtggagtgggatggatacgaacggtacngtcggtctacaataaattncgacaagagtagttcgagggcagggtaccacgagtacgacgaggacacgtacagtacaagtacacgactacgagtacggaactggacgacgaggtctaggacgnttacgagacgaaccgtaccgggtacgttgttacgttagttggtacgagtaggagtaagtgtaacgttcttacgttacgttacgtaggtttaacggggg

SEQ ID NO: 351507 - DNA, 540 bp, Homo sapiens
  misc_feature: GZ8MTXP02IEN8T.39.87.H10.1.454.CMB.2.raw
  modified_base (285)..(285): a, c, t, g, unknown or other
  misc_feature (285)..(285): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (506)..(506): a, c, t, g, unknown or other
  misc_feature (506)..(506): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagaagcctgggcctcagtgaggtctctgcaaggcttctggaatcaccctcaccgacgtctatatgcactggttncgacacggcccctaggacgagggcttgagtggagtgggatggatacgaaccggtaacagtgctanaacaaattntgacacgaagtaagtttcgagggtcagggtacacgatcgaccgagggacaccgtacaataccatacacgtctacagtagaacgtgagacgaggtacagagactacgtgaacgacgacggtccgtagttaatacgttcgacgagtagngtagtagacgtactttcttaccttaacgtttagg

SEQ ID NO: 351508 - DNA, 542 bp, Homo sapiens
  misc_feature: GZ8MTXP02GELIR.39.87.H10.1.454.CMB.2.raw
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (366)..(366): a, c, t, g, unknown or other
  misc_feature (366)..(366): n is a, c, g, or t
  modified_base (444)..(444): a, c, t, g, unknown or other
  misc_feature (444)..(444): n is a, c, g, or t
tcagtcgcactagtcacgaccggtgctcgatttagcagtactgcgttgagtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagagccgtggggcctcagtgaggtctctgcaggcttcnggatcaccctcaccgcgtctatangcagtggtgcgacacggcccctaggacgaagggtcttggaggtggagtggggatggataccgaacggtacaggtcggtactacgaactaattntacgacaagagtaagtttcgagggacgagggtaccacgagtacgaaccgaggaccacgtaccatacaatacagaccanagtagactgacgcgaggctagagatcgagacgacgacggtccgttagtacttagtcgtggagaaggtagagtacgtagttacttcgttacgttaacgg

SEQ ID NO: 351509 - DNA, 545 bp, Homo sapiens
  misc_feature: GZ8MTXP02G5A9F.39.87.H10.1.454.CMB.2.raw
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
  modified_base (514)..(514): a, c, t, g, unknown or other
  misc_feature (514)..(514): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtgggcctcagtgaaggtctcctgcaaggcttctggaatccaccctcaccgacgtctatatcgcacgtggttgcgacacggcccctggacgaaggcttggagtggagtgggatggatacgaacggtacagtcgtactacgaactaaattatcgacaacgtagtaagtttcgaagggtactacggtacacagtacgacgaggacacgtcagtacaagtacacgactanagtagaactgacgacgaggcgtaggancgtacgagacgacgtacggtacgtagtacttgtacgtgacgagagngtagtactacgtctacgtacgtagttacggg

SEQ ID NO: 351510 - DNA, 633 bp, Homo sapiens
  misc_feature: GZ8MTXP02GCBP4.39.87.H10.1.454.CMB.2.raw
  modified_base (249)..(249): a, c, t, g, unknown or other
  misc_feature (249)..(249): n is a, c, g, or t
  modified_base (577)..(577): a, c, t, g, unknown or other
  misc_feature (577)..(577): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactggaggtgaagagccgtggggcctcagtgaaggtctcctgcaaggcttcnggaactccaccctcaccgacgtctatatgcctacgttggttcgaccgacgacgggtcccccgtggaacgacgggcttaggacggtgggagtggggtactggggactacggaaacggtaaccgaggttacggtcctacgaactaaattacgtcggaacctaacgaaggtaaaccgtttcgaaggggtcgtaacggggtccaaccgtagtacgaccgacgggaacaccgtaccaagtaccaataccagtaccctaagactacggtaacgacggaggacgaggacgaggaagtacttacgacgaccggacgtaccggcgtagtacttacgngtcgacgtagacgtaagtaccggtaaattcgttacgtacgtacggttaacctttcg

SEQ ID NO: 351511 - DNA, 616 bp, Homo sapiens
  misc_feature: GZ8MTXP02GL4LZ.39.87.H10.1.454.CMB.2.raw
  modified_base (143)..(143): a, c, t, g, unknown or other
  misc_feature (143)..(143): n is a, c, g, or t
  modified_base (521)..(521): a, c, t, g, unknown or other
  misc_feature (521)..(521): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctnttcttggtggcagcagccacaggagcccactcccaggtgcagctggtgcagtccgggactggggtagagaagccgtcgggcgtcagtgaaggtctcctgcgaaggtcttctggaatcacccaccaccgacgtactatatgcactggttgcgacacggccccgtcggagaacggcgttgaggtagggagtgggagtggatacgtaacggtaaccgtagtggtctacactaaaattatgacacgaagtaagtttacgacgggacgacggggttacaccctaagtagaccgaacggggaactaccgtaccataactaaacaacgactaccctaagaacgttagggaaacctgaaggccaagggaccgttagaatacggttnacggacgaacgaccggtaccgtaggttattaagttgtacggacgtaagagtaacgtagtacgttacttctttaccctagttacgggtttaagggg

SEQ ID NO: 351512 - DNA, 513 bp, Homo sapiens
  misc_feature: GZ8MTXP02FHX91.39.87.H10.1.454.CMB.2.raw
  modified_base (342)..(342): a, c, t, g, unknown or other
  misc_feature (342)..(342): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaggcttctggaatcaccctcaccgacgtctatatgcactggttgcgacacggcccctggacaagggcttgagtggatggggatggatcaacggtacagtggtcncacaaatatgcacagaagtttcagggcagggtcaccatgaccagggacacgtcatcaaatacagcctaacataggaactgagngagctgagatcngaacgacacggaccgtgtattattggcgacgagagagtaaggtagttactcttactacgtagttacggggtacggg

SEQ ID NO: 351513 - DNA, 542 bp, Homo sapiens
  misc_feature: GZ8MTXP02GB4R9.39.87.H10.1.454.CMB.2.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (436)..(436): a, c, t, g, unknown or other
  misc_feature (436)..(436): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (505)..(505): a, c, t, g, unknown or other
  misc_feature (505)..(505): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctnagtgaaggtctctgcaaggcttcnggaatcaccctcaccaacgtctatatgcactggttncgacncggcccctggacaagggcttgagtggagtggatggatcaacggtacagtgtctacaacaattgtcgacaacgagtacgttacgaggggcagggtccacgagtacgacccgagggtaccacgtaccatacaagtacacgtacctaanagtagaactaggacgacgacgntagganacgttgacgaccgacgacggtcgtagttaatagttcgacgngtagtaagattggaactcttactacgttacgtttagg

SEQ ID NO: 351514 - DNA, 537 bp, Homo sapiens
  misc_feature: GZ8MTXP02G9Y5P.39.87.H10.1.454.CMB.2.raw
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
  modified_base (501)..(501): a, c, t, g, unknown or other
  misc_feature (501)..(501): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatctctctgtgcagcagccacaggagcccactcccaggtgcagctggtgcagtccgggactgaggtgaagaagccgtggggcctcagtgaaggtctcctgcaaggcttctggaatcaccctcaccgacgtctatatgcactggttgcgacgtacggcccctggaactaagggtcttgagtggacgnggatgatcgaacgtacagtcggtactacacaaattncgacacgagtaagtttcgaagggcgtagggtcacccgtanacgacgagggacacggtcaataccaatacaagcctaacagtcggaactggaacgcgtaggctagagactgagaacgcgacgtccgtagtattacgtcgtacgngagaagagtacgtagtaactcttacctactttacgg

SEQ ID NO: 351515 - DNA, 583 bp, Homo sapiens
  misc_feature: GZ8MTXP02IZM6U.39.87.H10.1.454.CMB.2.raw
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (476)..(476): a, c, t, g, unknown or other
  misc_feature (476)..(476): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcgagtgaggtctcctgcaggcttcgtggaatccaccctcaccgacgtctatatgcacgtggtgcgacacggcccctaggacaaggctggagtggagtgggatggatacgaaacggtacgagtggtctacgaactaaattatgacctaagaagtaagtttaccgagggtacgagggtaccacgagtacgacgaagggaccacgtccagtacaatacngacctanagtacgacgtagagacgagctagaagtntacgaggaaccgacggacggtaccgttagtaacgtttagtacgttacggacggtaaggacggcgaaaggtacgttacccggaaggtcgggtaaacgtaaggtttagg

SEQ ID NO: 351516 - DNA, 600 bp, Homo sapiens
  misc_feature: GZ8MTXP02GCCTN.39.87.H10.1.454.CMB.2.raw
  modified_base (364)..(364): a, c, t, g, unknown or other
  misc_feature (364)..(364): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcaccgacgtctatatgcactggtgcgacacggcccctggacaagggcttggagtggatgggatggatacgaaacggtaaccagttggtctacaactaaagttntgacaacagtaagtttcgaaggggcagggtacaccagtacgaaccgaggggaaccacggtaccctaataccgaaacttaaccgaacgtaccctaacgacgttacggaacctggaacgacgaggcgtagaagtaactcgtacgaacgtacggaccggtaccgtagttacttagttcggacgtacggagtagtaagtcgtaaacgtccttacgttacgtacgttacgtttaacggggg

SEQ ID NO: 351517 - DNA, 612 bp, Homo sapiens
  misc_feature: GZ8MTXP02JVUAA.39.87.H10.1.454.CMB.2.raw
  modified_base (293)..(293): a, c, t, g, unknown or other
  misc_feature (293)..(293): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcgagtgaaggtctcctgcaaggcttctggaatccaccctcaccgacgtctatatgctactggttgcgacnggccccctggacgaagggtcttggacggtggagtggggatggatacgaaacggtaacaggtggtctacgaactaaattagtgacaacgtaagtaaacgtttccgaagggggacacggggtaccaaccgtagtacgaacccgagggaccacgtccaatacaatacacgacctacagtacggactgacgcgagcgtagacgtctacgtacgacgaccgtacggggtaccgttaggttaacgtttacgttacggtaggaaccggtaggaacgtaaggtagtacggttaacttcgtttacttaacggttaggtttaacggggg

SEQ ID NO: 351518 - DNA, 501 bp, Homo sapiens
  misc_feature: GZ8MTXP02JY541.39.87.H10.1.454.CMB.2.raw
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (405)..(405): a, c, t, g, unknown or other
  misc_feature (405)..(405): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatccctcttcttggtggcagcagccacaggagcccactccccaggtgcagctggtgcagtccgactgaggtgaagaagcctggggcctcagtgaaggtctcctgcaaggctctggaatcaccctcnccgacgtctatatgcactggttncgacaggcccctggcaagggcttgagtggattggggatggntcaacggtaaccagtggtctnacaaattatgcacngaagtttcngggcagggtcaccatgaccaggacacgtccatacanaacagcctacactgaactgagcgagcgtgagatctagacacgtacggccgtgtattatgtgcgagagaatgacgtactactcttactatttagggg

SEQ ID NO: 351519 - DNA, 577 bp, Homo sapiens
  misc_feature: GZ8MTXP02GIW62.39.87.H10.1.454.CMB.2.raw
  modified_base (256)..(256): a, c, t, g, unknown or other
  misc_feature (256)..(256): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactgaggtgaagagccgtggggcctcgagtgaaggtctccgtgcaaggcttcgnggaactccaccctcaccgacgtctatatcgctacgtggttcgcgacgacggcccctaggacgaggtcttaggaggtggagtgggatggatacgaaccggtangtcgtcacaataattgnacacgtagtagttcgagggcaggtcacagtacgacgagactaccgtacataacgaatacgacgtacctaagagtacggaaactggaacgcgaggtcaggagacttacgaggaaccgacgtaccgggtcgttacgttattacggttgagacggtaagtaagtaagtacgtacggtttaccttaccttacgttaacgtttaggg

SEQ ID NO: 351520 - DNA, 730 bp, Homo sapiens
  misc_feature: GZ8MTXP02H5L5X.39.87.H10.1.454.CMB.2.raw
  modified_base (186)..(186): a, c, t, g, unknown or other
  misc_feature (186)..(186): n is a, c, g, or t
  modified_base (708)..(708): a, c, t, g, unknown or other
  misc_feature (708)..(708): n is a, c, g, or t
tcagtcgcactagtcacgaccggtgctcgatttagcagtactgcgttgggtttgggatcacccagcaaccacatctgtcctctagagaatcccctgagagctccgttcctcaccatagactggacctggaggatcctcttcttggtggcagcagccacaggagcccactcccaggtgcagctggtncaggtccggactggagtagaagacgccggtgggcctgaggtaggacgttctccgtgacgtacggtcttgagtactaccaccctcgaccgactactatagtcgactacggttggtcgaccgacgtaccggtaccccgtagggacgtaagggtctagggtacggtagggagggtacgggtagtaggtaacgtaaccggtaaacggtaacgtgggtaccgtacctacgaaacttaaagttacgacgactaaacggttaaggttaaccggtttaccggaagggtaccgggtacgggtaccctaacccggtacgaccggaaacccggtaacgggaacccgtaacccgtaccggtaaactaccgtaaaacgacccgtaaccgtaaccctaagttaacggaacgggtaaacgttacgaacggtaccggaggggtacgtaacggacgtacgttagaccggaacgtaccggtaccggtagtaacgtttagtattacggacgtacgagtagtagtaagtacgtacttacgtntttacgtaggtttacggtaaag

SEQ ID NO: 351521 - DNA, 592 bp, Homo sapiens
  misc_feature: GZ8MTXP02HDPQ8.39.87.H10.1.454.CMB.2.raw
  modified_base (228)..(228): a, c, t, g, unknown or other
  misc_feature (228)..(228): n is a, c, g, or t
  modified_base (538)..(538): a, c, t, g, unknown or other
  misc_feature (538)..(538): n is a, c, g, or t
tcagtcgcactagtcacgaccggtgctcgatttagcagtactgcgttgggtttgggggcaggagtcagacccactcaggacacagcatggacatgagggtcccccgctcagctcctggggcttctgctgctctggctcccaggtgccagatgtgccatccagttgacccagtctccatcctccctgtctgcatctgtaggagacagagtcaccatcacgttgccgganaagtcgagggactaattaaaatgtattagcctaggtatcagacaacgaaaccgaggaaaactccgtaaaggtcctgatctatgatcgcctactaggtttaggaaagtcggggtaccagtacccgtaaggtcgaggcggacagtggacgtcgtaggactagtacttacactcctaccactactcaaccacgtcccgtggccggacctagtaagttactttgaacttaactttagtacttagtactaaacttatttaacttcttacgtcctcttacgtacgttcggacgggtaacggacgtaggtacggaanacgtacgaaacgtcgtacggtaacgtactcggactaccgtacttcgtcgtttac

SEQ ID NO: 351522 - DNA, 625 bp, Homo sapiens
  misc_feature: GZ8MTXP02IBFQ3.39.87.H10.1.454.CMB.2.raw
  modified_base (251)..(251): a, c, t, g, unknown or other
  misc_feature (251)..(251): n is a, c, g, or t
  modified_base (399)..(399): a, c, t, g, unknown or other
  misc_feature (399)..(399): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcaggtccggactggaggtgaagaagccgtggggcctgagtgaggtctcctgcaggcttcgnggaactccaccctcaaccgacgtctatactgctacgtggttgcgaccgacggtccccctagggaaccgaagggtcttaggaggtggagtcggggattacgggaactacggaaccggtaacgaggttcggtactacaaactaaatttcngacaacgtagttacgttcgagggcagggtacacgagtcgaaccgagggacacgtaccaataccaaactacacgtacctaagacgttaggactaggaacgcgaaggtctaggaacgttactcgtacgaaccgtacggacgggtacgttagttaacgttagttcggtagtacggtaagtaagtagttaacggtactttaccgttccgtttacgttacggtttaacggg

SEQ ID NO: 351523 - DNA, 549 bp, Homo sapiens
  misc_feature: GZ8MTXP02GT7JD.39.87.H10.1.454.CMB.2.raw
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (437)..(437): a, c, t, g, unknown or other
  misc_feature (437)..(437): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttcgtggaactcaccctcaccgacgtctatatgcactggtgcgacacggcccctggacaggcttgagtgatggatggatcaacgtacngtgtcncacaaattntgcacgagagttnagggtcaggtcacatgacagggacacgtcatacaatacacgacctaagacttagggaaccttaggagccgaagggntaggacgtacgtacgtagaaccgtaacggtacggtaccgttagttacgttagttcggtacgtacgtaaggaagtacgtacgtacgttaccttacgtttacgtaacgttacgg

SEQ ID NO: 351524 - DNA, 583 bp, Homo sapiens
  misc_feature: GZ8MTXP02H5L6X.39.87.H10.1.454.CMB.2.raw
  modified_base (274)..(274): a, c, t, g, unknown or other
  misc_feature (274)..(274): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
tcagtcgcactagtcacgaccggtgctcgatttagcagtactgcgttgggtttggggatcacccagcaaccacatctgtcctctagagaatccccctgagagctccgttcctcaccatggactggacctggaggatcctcttcttggtggcagcagccacaggagcccactcacaggtgcagctggtgcagtccgggactgaggtgaagagccgtgggcctcagtgaggtctctgacaggtctcgtggaatccaccctcacccgacgtctatancgcacgtggtcgcgacgcggcccctggaacgagggtctggaggtggagtgggatggatacgaaggtaccaggtgtactactaactaaattgtnacaanagtaagttcgacggggtacagggtacccaacgngtacgacgagggacacgtacatacaaacactacgacctaacaagtacggtaactagggactaccggaagacgtaggaacgtagtaccgtaggaaccgaacggtcgtacggttagttactagttagacgacgagagtaagtacgtacgtactagtttaccgtacgttaggtttaacggg

SEQ ID NO: 351525 - DNA, 493 bp, Homo sapiens
  misc_feature: GZ8MTXP02FE7CI.39.87.H10.1.454.CMB.2.raw
  modified_base (350)..(350): a, c, t, g, unknown or other
  misc_feature (350)..(350): n is a, c, g, or t
  modified_base (435)..(435): a, c, t, g, unknown or other
  misc_feature (435)..(435): n is a, c, g, or t
tcagtcgcactagtcacgaccggtgctcgatttagcagtactgcgttgggttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggctctggaatcaccctcaccgacgtctatatgcactggttgcgacaggcccctggacaagggcttgagtggatgggatggatcaacggtacagtggtctcacaaattntgcacagaagtttcagggcagggtcaccatgacagggacacgtccatcaaatacagacctacatggaactgaagcgagctgagancagacgacgacggcgtagtattatgtcgagagaagagtagtacgtactctactactag

SEQ ID NO: 351526 - DNA, 569 bp, Homo sapiens
  misc_feature: GZ8MTXP02I4XP8.39.87.H10.1.454.CMB.2.raw
  modified_base (221)..(221): a, c, t, g, unknown or other
  misc_feature (221)..(221): n is a, c, g, or t
  modified_base (365)..(365): a, c, t, g, unknown or other
  misc_feature (365)..(365): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttgccgggnaagtcaggactaattaaaatgtatttagcctggtatcagacaagaaaccgaaggaaaactcctaaaggtcctagattctatgatcgcctacgtagtttggaaacggtgggtacccagtacgtaaggttccagcgcagtgatcgngggactagtatttcacttcacacatcaccagtcctgcgtactagaatatttgactaatttatactgtactaacttaatttattacgtactccgtacttacgtaacgtttcgggacggtaagggtacctaagggtacgagtactaacgaaaacgtacgtcggtcggacttgaccctacgtacttccgtgttaccttacttacccg

SEQ ID NO: 351527 - DNA, 559 bp, Homo sapiens
  misc_feature: GZ8MTXP02FHKCS.39.87.H10.1.454.CMB.2.raw
  modified_base (226)..(226): a, c, t, g, unknown or other
  misc_feature (226)..(226): n is a, c, g, or t
  modified_base (403)..(403): a, c, t, g, unknown or other
  misc_feature (403)..(403): n is a, c, g, or t
  modified_base (536)..(536): a, c, t, g, unknown or other
  misc_feature (536)..(536): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctggtaggagacagagtccacatcacttggccggganaagtcgagggactaaattaaaatgtaatttacgcctggtatcagcaaacgaaaccgaagggaaaactcctaaggtctgatctatgatcgcctcgtaaggttaggaaaggttcgggtaccatacgtaaggtccagtcgagaggtgagtcgtgggacagtattcacttcacacatcacngctgcgtcagtaagttatttcgaacttacgtttatactagtactaaattattttaacttactactccgtattctacggttcggacgggtacgggaacgaaggtcggataactaccgaaacacgttgacggctnacctactatcgtctacctctacg

SEQ ID NO: 351528 - DNA, 559 bp, Homo sapiens
  misc_feature: GZ8MTXP02H8X02.39.87.H10.1.454.CMB.2.raw
  modified_base (258)..(258): a, c, t, g, unknown or other
  misc_feature (258)..(258): n is a, c, g, or t
  modified_base (376)..(376): a, c, t, g, unknown or other
  misc_feature (376)..(376): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggacgcccactcccaggtgcagctggtgcaggtccgggactggaggtgaagaagccgtggggcctcgagtgaaggtctctgcaaggtcttcgnggactccaccctcaccgacgtctatatgctatggttgcgtacgcggcccctggacgaggtcttggaggtggagtgggataggatacgaaaccggtagaggtcgactacaactaaattntggacacgtaagtaagttcggaggtacacgggtcaacgagtacggaaccgaggacctacgtacaatacagtaacacgcctaacagtagaactgagcgagactagagtatcgtagacgacgacggttcgtagttattagtcgtagacgagaagagtagtacgtactcttacgttaacgttaggg

SEQ ID NO: 351529 - DNA, 582 bp, Homo sapiens
  misc_feature: GZ8MTXP02FOYMM.39.87.H10.1.454.CMB.2.raw
  modified_base (250)..(250): a, c, t, g, unknown or other
  misc_feature (250)..(250): n is a, c, g, or t
  modified_base (370)..(370): a, c, t, g, unknown or other
  misc_feature (370)..(370): n is a, c, g, or t
  modified_base (409)..(409): a, c, t, g, unknown or other
  misc_feature (409)..(409): n is a, c, g, or t
  modified_base (536)..(536): a, c, t, g, unknown or other
  misc_feature (536)..(536): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctgagtgaggtctcctgcaggcttcgnggaatccaccctcaccgacgtctatatgctacgtggttgcgacgacggcccctggacgagggtcttggaggtggagtgggatggatacgaaacggtacgaggtggtctacaactaaattntgacaacgagttaacgttcgaggggcgagggtccaaccngtacgaccgagggaccacgtaccatacaaactacacgtacctagagtagacgtaggacgtacgaggtactaggacagtaccgacgaaccgacgtacgggtccgttaagttagtttacgttcgtacgngtaagtaagtagtagtacgttactttactacgttaacgtttagggg

SEQ ID NO: 351530 - DNA, 621 bp, Homo sapiens
  misc_feature: GZ8MTXP02JJ3XU.39.87.H10.1.454.CMB.2.raw
  modified_base (187)..(187): a, c, t, g, unknown or other
  misc_feature (187)..(187): n is a, c, g, or t
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (280)..(280): a, c, t, g, unknown or other
  misc_feature (280)..(280): n is a, c, g, or t
  modified_base (316)..(316): a, c, t, g, unknown or other
  misc_feature (316)..(316): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtncagtccgggactgaggtgaagagcctggggcctcagtgaaggtctctgcaggtcttcnggaatcaccctcaccgngtctatatgcactggtcncgacacggccctggacagggcttggagtcggatggntaggactacgtaacggtacaggtcggtacctcaactaaattgtacgccgtacgtaaggtaacggtttccgaagggggtactaacgggggtccaaaccgagttcggaaaccgacggggtacacccggttacacgtacaaacgttacgacgtaccttaacgagttacggaaccgttggacgacggaacgtccgttagacgtaacgtcgtagaccgtacgaacgggtcctagttacttacgttggcgtacgtaggactagtaagtacgtaacctttctacgttaccgttacggttaggggtttaacgg

SEQ ID NO: 351531 - DNA, 549 bp, Homo sapiens
  misc_feature: GZ8MTXP02JBTNX.39.87.H10.1.454.CMB.2.raw
  modified_base (375)..(375): a, c, t, g, unknown or other
  misc_feature (375)..(375): n is a, c, g, or t
  modified_base (469)..(469): a, c, t, g, unknown or other
  misc_feature (469)..(469): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctcttcttggtggcagcagccacaggagcccactcccaggtgcagctggtgcaggtccgggactggaggtgaagagccgtggggcctgagtgaggtctctgcaggcttgtaggatccaccctcaccgacgtctatatgctacgtggttgcgacacggtcccctaggaacgaagggtcttagaggtggagtgggatggaatacgaaacccggtatagtacgtactacaataaatttncgactaacgtaagtagtttacgaagggtcgaaggtcacgtagcgaacgaggacacgtacatacataacacgctaacgagtacgactggacgagngcagaacgcacgagaacgacgacgtgtaggttaatcgttgaacgagaagaagacgtagtactactcgtttactagtacgg

SEQ ID NO: 351532 - DNA, 588 bp, Homo sapiens
  misc_feature: GZ8MTXP02FTSOI.39.87.H10.1.454.CMB.2.raw
  modified_base (251)..(251): a, c, t, g, unknown or other
  misc_feature (251)..(251): n is a, c, g, or t
  modified_base (373)..(373): a, c, t, g, unknown or other
  misc_feature (373)..(373): n is a, c, g, or t
  modified_base (460)..(460): a, c, t, g, unknown or other
  misc_feature (460)..(460): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccggactggaggtgaagaagccgtggggcctcgagtgaaggtctcctgcaaggcttnggaactccaccctcaccgacgtctatatgcactggtgccgacgaccgggcccctaggacgaaggtcttggaggtggagtggggatggatacgaaacggtacgagtgtctacaactaaattgngacaacgtaagtacgttacgagggacctagggtaccacgagtcgaaccgagggaccctacgtaccaatacaaatacgacgacctaanagtacggactgaagcgagctagacgtatcgacgacgaccgacggtcgtttagtaacgtttagtacgtaggtacgaagtaaggtaagtaacgtacgttacttctttacgacgtttaggtttaacggggg

SEQ ID NO: 351533 - DNA, 592 bp, Homo sapiens
  misc_feature: GZ8MTXP02IN7J6.39.87.H10.1.454.CMB.2.raw
  modified_base (198)..(198): a, c, t, g, unknown or other
  misc_feature (198)..(198): n is a, c, g, or t
  modified_base (259)..(259): a, c, t, g, unknown or other
  misc_feature (259)..(259): n is a, c, g, or t
  modified_base (371)..(371): a, c, t, g, unknown or other
  misc_feature (371)..(371): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtcctccatcctcctgtctgcatctgtagganacagagtcaccatcacttggccgggcaagtcagggactaaattaaaatgtattagctgtancagacaagaaaccaggaaaacctcctaaggtcctagatctatgatcgcctacgtaggtttaggaaacggtcgggtaccagtacgtaaggttccaggcggcaggtggattcgnggggactagtattccactcacaccataccaccacgcctaggcccggtactaggaattacgtttacgacttaatttacgttactagtaactaaattaatttacgttctactccgtactactacggttacggacgggtaacggaacgtaagggtcgaactaacgtaaacgaaacgtaacgtggtacggtacaacgacctactactccttagtaccttactccc

SEQ ID NO: 351534 - DNA, 548 bp, Homo sapiens
  misc_feature: GZ8MTXP02IQ13V.39.87.H10.1.454.CMB.2.raw
  modified_base (368)..(368): a, c, t, g, unknown or other
  misc_feature (368)..(368): n is a, c, g, or t
  modified_base (436)..(436): a, c, t, g, unknown or other
  misc_feature (436)..(436): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaggcttctggaatcaccctcaccgacgtctatatgcactggttcgcgacacggcccctggaccaagggtcttaggagtgggatgggatggatacgaacggtaaccagtggtctacaacgtaaattangacacgaagtaagtttcgagggcgacgggtcacatcgacgaggacacgtccatcaaatacagacctanagtagactagagcgagctagagatcgtagacgacgtacggacgttagtactttagtcggtagacgagagtaagtgtaacgttacttacgttacttacgttacgtttaggggg

SEQ ID NO: 351535 - DNA, 569 bp, Homo sapiens
  misc_feature: GZ8MTXP02HTD6Y.39.87.H10.1.454.CMB.2.raw
  modified_base (226)..(226): a, c, t, g, unknown or other
  misc_feature (226)..(226): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcacatcacgttgccggganaagtcgagggactaattaaaatgtattagccttaggtatcagacaagaaaccgaaggaaaacctcgtaaggtcctagatctatgatcgcctacgtagttaggaaagtcggggtacccagtaccgaaggttcaggcggagaggtggatcgtaggactagtatttcacttcacacatccacancctgcgctagaagttnttagacttaattattacttagtactaaacttaatttattcttaactccgtcttacgtacgtttacgggacggtacggtaccgaagggtacgagtaaacaccgtaaaacgtaacgttggtaacggcacgacaaccttactcttactc

SEQ ID NO: 351536 - DNA, 567 bp, Homo sapiens
  misc_feature: GZ8MTXP02H0SHM.39.87.H10.1.454.CMB.2.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctnagtgaaggtctcctgcaaggcttcnggaactccaccctcaccgacgtctatatgctactggtgcgacgacggcccctggacaagggcttgaggtggagtgggatggaatcgaaacggtaacnggtggtctacaaactaaattangcaacgaagtaacgtttcgaaggggtcgaaggggtccaaccagtacgaaccgagggacaccgtaccaatacaaatacgagacctaacagtaggaacgtgagcgaaggctagagtatcgtagacgacgacggtcgtagttattagttgtcgacggagtagagtaaggattactcgttactacgttagttaggggttacggg

SEQ ID NO: 351537 - DNA, 592 bp, Homo sapiens
  misc_feature: GZ8MTXP02JL91R.39.87.H10.1.454.CMB.2.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (576)..(592): a, c, t, g, unknown or other
  misc_feature (576)..(592): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggacgcccactcccaggtgcagctggtgcgaggtccgggactggaggtgaagagccgtggggcctgagtgagtctcngcaggctnggatccacctcaccgtacgtctatatgcagtggtgccgacgaccggcccctgggaaccaagggcttggaggtggagtgggatggaatcgaaaccggtagaggtcggtcttacgaaaactaattgtcgactaaacgtaagggtaacgtttcgggaagggtccgtaaagggggtacctaaccgaacgttacggaaccggtaacggggaacctacccggtaacctaacgtacgaaaacttaaccgaaaccgaccctaaacgtagtaacggtaaccgtaggggaaaggccgggggtacacggggacgaaacgggcgaacgagtaaggcgnnnnnnnnnnnnnnnnn

SEQ ID NO: 351538 - DNA, 666 bp, Homo sapiens
  misc_feature: GZ8MTXP02IY360.39.87.H10.1.454.CMB.2.raw
  modified_base (363)..(363): a, c, t, g, unknown or other
  misc_feature (363)..(363): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcacgtggttgcgacacggcccctggacaagggcttggagtggatgggatggatcgaacggtaacaggtcgtctacaacgaaatttangcaacaagtaacgttcgagggccgaggggtccaaccaagtgacccgaaggggaaccacggtacccaagtacctaaactacaacggaccccttaaagaacgttaacggggtaaacctagggaacggacggtaacggtccggtagaaacggcgttaccgtaaggaacggaccgaaacgggtacccggtttacggttaaaacttacggggtttacgtacgggtacggtaacggtaaacggtaacggtaacggttaacggttaaccgttaaccgtttaaccgtttaaccgtttaacggtttaacggg

SEQ ID NO: 351539 - DNA, 534 bp, Homo sapiens
  misc_feature: GZ8MTXP02I41SZ.39.87.H10.1.454.CMB.2.raw
  modified_base (362)..(362): a, c, t, g, unknown or other
  misc_feature (362)..(362): n is a, c, g, or t
  modified_base (435)..(435): a, c, t, g, unknown or other
  misc_feature (435)..(435): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcactggttgcgacacggcccctggacagggcttggagtggagtgggatggatcgaaccggtacagtggtctacaactaaattntgacaactagtaagtttcgaggggctagggtcaccgagtcgacgagggacacgtacatacaatacagcctaanagtagaactgagcgaggcgtagagtactacgacgacgacgacggaccgtagtacttacgtcgtagcgagaagatagacgtacttacttactacgttagg

SEQ ID NO: 351540 - DNA, 607 bp, Homo sapiens
  misc_feature: GZ8MTXP02GAXMV.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtccacctatcacgttgtcgggacaagtcgaggactaattaaaatgtattagctaggtatcagacaagaaaccgaaggaaaactccgtaaggtcctagattctatgatcgccttacgtaggtttaggaacggttcggggtaccaagttacgtaaggttcccgaggcggacgaggtggacgttcgtggggactagtacttcactctacacactaccaccacgccgtgccgtactagtaacgttactttcgaacttaactttattactagttaactaaacttaactttactttcttactccgtacttacgttacgttcgggacgggtaacggacgtaaggtaggaacgtactaaacgaaacgtacgtggtacggtactcgactacctatcgtacgttctactacccg

SEQ ID NO: 351541 - DNA, 570 bp, Homo sapiens
  misc_feature: GZ8MTXP02G78WC.39.87.H10.1.454.CMB.2.raw
  modified_base (224)..(224): a, c, t, g, unknown or other
  misc_feature (224)..(224): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (460)..(460): a, c, t, g, unknown or other
  misc_feature (460)..(460): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctnagtgaaggtctcctgcaaggcttctggaactcaccctcaccgacgtctatatgcacgtggtgcgacacggcccctaggaccaagggcttaggagtgggagtgggactggactacgaaacggtaaccnggtgtactacgaactaaaagttntgacaacgtaagtaagtttaccgaagggcgtaaggggtaccaaccgatcggaaccgagggacacgtccaatacaatacagacctanagtaggaactgagacaggctagagtatcgtagacgacacggcgttatacgttagttcggacgacgtagagtaagtagtacgttactactttacgtaacttaggttagggg

SEQ ID NO: 351542 - DNA, 582 bp, Homo sapiens
  misc_feature: GZ8MTXP02JXDOQ.39.87.H10.1.454.CMB.2.raw
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
  modified_base (458)..(458): a, c, t, g, unknown or other
  misc_feature (458)..(458): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaactccaccctcaccgacgtctatatgcacgtggtcgcgacacggcccctggacaagggcttggagtggagtgggatggatacgaacggtaaccngtggtctacaacgtaaattangacaacgtaagtaagttacgaggggtacacgggtaccaaccgtagtacggaaccgagggacctacgtaccaatacaaataccaagacctanaagtcggaaactggaacggtcgacggtgacggaagacgtacgacgacgacgaccggtacgttagttacgttagtcgtcgacgagtagaagttagaacttctacgttacctacgtagtttcgggg

SEQ ID NO: 351543 - DNA, 585 bp, Homo sapiens
  misc_feature: GZ8MTXP02JKZ31.39.87.H10.1.454.CMB.2.raw
  modified_base (250)..(250): a, c, t, g, unknown or other
  misc_feature (250)..(250): n is a, c, g, or t
  modified_base (364)..(364): a, c, t, g, unknown or other
  misc_feature (364)..(364): n is a, c, g, or t
  modified_base (489)..(489): a, c, t, g, unknown or other
  misc_feature (489)..(489): n is a, c, g, or t
  modified_base (543)..(543): a, c, t, g, unknown or other
  misc_feature (543)..(543): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccggactgaggtgaagagccgtggggcctcgagtgaaggtctcctgcaggtcttgnggaactccaccctcaccgtacgtctatatcgctacgtggtagcgaccgacggtccccgtaggacgtaacggtcttaggaggtggagtgggacgtgacgtacgaacggtaaccgnggttcgtactacaactaaagttgcgacgaacgtaagttaacgttgaacggggctagggtaccaccgtagacggaccgtagggacctacgacaagtacaactacgacgacctagaagtacgtacgngacgagacgtagacggattacgcgtaacgacgacgtacggcttagaattgtcgngaacgtagagtgtagtcgtactctacgtagtacgtttagggg

SEQ ID NO: 351544 - DNA, 532 bp, Homo sapiens
  misc_feature: GZ8MTXP02FUKUY.39.87.H10.1.454.CMB.2.raw
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaggcttctggaatcaccctcaccgacgtctatatgcactggttcgcgacgacggcccctggacgaagggtcttgaggtggagtgggatggatacgaaacggtaacngtgtctacgactaaatntgcacagtaagttcgagggtcgagggcacagtacgacgagggacacgtcatacaatcagcctaacagtaggaactgacgacgaggctagagatacgagacgacgacggacttatattagtgagacgagagtagtgacgttactcttactacgttacgtcggtttaacggg

SEQ ID NO: 351545 - DNA, 523 bp, Homo sapiens
  misc_feature: GZ8MTXP02F83M3.39.87.H10.1.454.CMB.2.raw
  modified_base (234)..(234): a, c, t, g, unknown or other
  misc_feature (234)..(234): n is a, c, g, or t
  modified_base (364)..(364): a, c, t, g, unknown or other
  misc_feature (364)..(364): n is a, c, g, or t
  modified_base (444)..(444): a, c, t, g, unknown or other
  misc_feature (444)..(444): n is a, c, g, or t
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
  modified_base (500)..(500): a, c, t, g, unknown or other
  misc_feature (500)..(500): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagctgggcctcagtgaaggtcncctgcaggctctggaatcaccctcaccgacgtctatatgctactggttgcgacacggcccctggacaagggtctgagtggagtgggatggatacgaaccggtaacagtggtctacgaactaaagtttacngacaacgtaagtaacgtttcgaggggtcaaggggtccaccgatacggacgagggacacgtaccatacaatacagacctanagtgaactgagcaggctgangtacngacgacacggcgtatagtatcgtagacgagngtatagacgtactctacattagg

SEQ ID NO: 351546 - DNA, 663 bp, Homo sapiens
  misc_feature: GZ8MTXP02I43R9.39.87.H10.1.454.CMB.2.raw
  modified_base (247)..(247): a, c, t, g, unknown or other
  misc_feature (247)..(247): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcgagtgaaggtctctgcaggcttcgngaactccaccctcaccgtacgtctatatcgctacgtggttcgaccgtacgaccggtccccgtaggaaccgtaaggggtctttagggaggtgggtagtggggattgggaactaccggaaaacggttaacacggttcgtactaccgaaacttaaattacgtgaccgtaacgtaaggttaaacggtttccgaacgggggtcgaacggggtacccaacgtagtaccggaacccgaaggggaccctaaccgtacctaatacaaacgtaccgaacgcccttaaacgaggtacggaaccgtgaacgacgtacggacgtagaaggacttcggagaccgacgtaccgggtacgttagtttagttagtcggtagacgagtatagtaagtacttactcgttactaccgtaggtttacgggttaacgg

SEQ ID NO: 351547 - DNA, 847 bp, Homo sapiens
  misc_feature: GZ8MTXP02G5UFE.39.87.H10.1.454.CMB.2.raw
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttcgacccagtctccatcctccctgtctgcatcgtgtaggagacagagtccaccatcacgttcggccgggacaagtcgagggactaaattaaaactgtattacgcttaggtactcgagacaacgaaaaccgaagggaaaacctcgtaacggtcctagacttctatagacgtcgtacccttacgttaaggtttagggaaacggttcggggtaccctagtacgtaaggttccgacggcggacgtaggtcggtaacgttcgacggggtactaggttacctttaccacttaccctaccaaaccctactacccaaccgtacgtcccgtacgggacccggtaccgttaaggtaaacgtttaaccgtttttacgaaacccgtttaaaacgttttaaaccttaaccggtttaaacgttaaaacctttaaaaacccgttttaaaatttttttaacccttacccgtttaaacccgtttcccccggttaaccttttaacccggtttaaaccggggttttaccccgggggaaacgggggtaaaccgggggtaaaacccggttaaagggggtttaacggggaaactttaaacggtaaaacccggttaaaaacccgggtcggttacggggtccggttaacctaaccggaaccctaaccccgtttagttccggtttacgtttacccctttaccggtaacccccg

SEQ ID NO: 351548 - DNA, 606 bp, Homo sapiens
  misc_feature: GZ8MTXP02GCAU4.39.87.H10.1.454.CMB.2.raw
  modified_base (381)..(381): a, c, t, g, unknown or other
  misc_feature (381)..(381): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtccgggactgaggtgaagagcgtggggctcgagtgaaggtctccgtgcgaaggtcttcgtaggaactccaccctcaccgacgtctatatgctacgtggtgcgacacggccccgtaggaccgaaggtcttaggagtggagtgggagtaggactacgaacggtacgtagtgtactacaaactaaattncgacaacgaagttaacgttacggaggggacgagggtacctaaccgagtacggacgagggaccacgtaccaatacaaatacgaaccgactaacgtaacgtacggaaactaggaaggaccgacggtacgtaggaacgtactcgacggaaccgaacgacccgggtcgttagtattagtgacggagtaagaagtagtaggtacttaccttacttaccgtagttacgggg

SEQ ID NO: 351549 - DNA, 582 bp, Homo sapiens
  misc_feature: GZ8MTXP02JUIMR.39.87.H10.1.454.CMB.2.raw
  modified_base (200)..(200): a, c, t, g, unknown or other
  misc_feature (200)..(200): n is a, c, g, or t
tcagtcgcactagtcacgaccggtgctcgatttagcagtactgcgttgggtttggggggagtcagacccactcaggacacagcatggacatgagggtcccccgctcagctcctggggcttctgctgctctggctcccaggtgccagatgtgccatccagttgacccagtctccatcctccctgtcctgcatctgtagganacagagtcaccatcacttgccggcaagtcaggcataaaatgattgcctggatcagcaagaaaccagggaaactcctaaaggtcctgatctatggatgcccttccaggtttagggaaaggttcggggtccctaagtactaaggttcccaggcgacaggtggatcgtggggacaggtatttcactcactaccatccaccagcctagccgtacctaggatacgttttagacttaacttattaccgtatactaaacttaattaaatttcttaacttccgacttctaccggttcggaccggggtaggaacccgtaaggtggagtaacaccgtaaaacggtaccttcgggcgcgtaacgactactacgttcttacgtacttacctacg

SEQ ID NO: 351550 - DNA, 635 bp, Homo sapiens
  misc_feature: GZ8MTXP02IBT8A.39.87.H10.1.454.CMB.2.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (455)..(455): a, c, t, g, unknown or other
  misc_feature (455)..(455): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagagccgtggggcctcagtgaaggtcnctgcaggcttngaatcacccncaccgacgtctanatgcactggttgctacncggcccctggacaggcttagacgtggatgggatggatacgaaccggtaacagtcgtactacgactaaattatgaactaccgaaagtaacgtttcgaaggtcgtaaggtcaacccgagtacgaaccgaagggtacaacgtccaattaacgactaacgacgtacctanacgttacggaaacttgaaacgccgtaagggtacctaggaacgtaagtcgttaacggaaacgtaccggaaaccgggttcccgttaagtttaaaccgtttacgtttacggttacgaacgttacggaaacgttacgtagggtacgttaaccgtttcctttaaccgtttaaccgtttaacgggg

SEQ ID NO: 351551 - DNA, 699 bp, Homo sapiens
  misc_feature: GZ8MTXP02GDCA4.39.87.H10.1.454.CMB.2.raw
tcagtcgcactagtcacgaccggtgctcgatttagcagtactgcgttgggtttgggggcatcacccagcaaccacatctgtcctctagagaatccccctgagagctccgttcctcaccatggactggacctggaggatcctcttcttggtggcagcagccacaggagcccaatcccaggtgcagctggtgcaggtccgggactgaggtgaagagccgtggggcctcgagtgaggtctcctgcaggcttcgtggaactccaccctcaccgacgtctatatgcacgtggtgcgacgcggccccgtaggacgaggtctggaggtggagtgggataggatacgaaaaggtaccgaggtcggtactacgtaaactaaattgagactaaacgtaaaggtaacgtttacggaaggggtacgtaaggggttaccaaccgtagtacggaaccggaacggggaaccgtaaccggtaccctaaataacctaaacgtaaccgacgtaacctaacgtaacggtacggtaaacgaggaacgggacgaacgggtccgtaaggaacgtacgtaccggttaacggaaccgaacccggtaaccggggtacccgttaagggtttaatttacggttaggtacggtacggaaggtaaggtaagtacggttaacggttacctttaccgtttaaccgttacggtttaggtttaaacgggggg

SEQ ID NO: 351552 - DNA, 640 bp, Homo sapiens
  misc_feature: GZ8MTXP02I4LJO.39.87.H10.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatccctccctgtctgcatctgtagganacagatcacatcacttgccggnagcgaggactaattaaaatgtattagctggtatacagacaacggaaacgaaggaaacctcgtaaggtcctagatctatgatcgcctccgtaggtttagggaaacggttccggggtacctaagtaccgtaaacgttcgagtcggtctagggtagtcgtacgtaggggaactacgttactttcgacctctaccactaacctcaaacccgcgtccgtcggcccggtactagtaaagttatttacgaactttaactttagtacttacgtaaacttaaactttaaactttaacttacgttactccgtacttaccgttaccgtttcggggacggaacgggtaaccgtagggtacggtaagtaactaaccgaaaacgtacgttcggtcggtactacggactaccgtacgttcgttactttccg

SEQ ID NO: 351553 - DNA, 595 bp, Homo sapiens
  misc_feature: GZ8MTXP02I1WCP.39.87.H10.1.454.CMB.2.raw
  modified_base (251)..(251): a, c, t, g, unknown or other
  misc_feature (251)..(251): n is a, c, g, or t
  modified_base (361)..(361): a, c, t, g, unknown or other
  misc_feature (361)..(361): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaggcttnggaactcaccctcaccgacgtctatatgctactggttgcgacgacggcccctggacaggctgagtggagtgggatggatcgaaacggtacagtgtactacaactaaattngacaacgtagtaagtttcgaagggcgaagggtacaaccgtagtacggaccgtaagggacctacggtaccaagtacaaacgtacgaacgaccctaagacgtacggaactcggagacgaggaccgtaggaacgtagtaccgagaaccggtacgaccgggtaccgttagtaagtttacgtggtacgacggtaagaagtacgtaggtacgtacttaccgttacgtacgtttaacgggg

SEQ ID NO: 351554 - DNA, 571 bp, Homo sapiens
  misc_feature: GZ8MTXP02IB6AM.39.87.H10.1.454.CMB.2.raw
  modified_base (368)..(368): a, c, t, g, unknown or other
  misc_feature (368)..(368): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcacccctcaccgacgtctatatgcactggttgcgacacggcccctggacaagggcttaggagtggatgggatggatacgaaccggtaacaggtggtactacgaactaaattntcggacaacgtaagtaagtttcgaagggtcgaaggggttacaacccgtagtacgaaccgaagggaccaccggtaccaagtaccaatacacgacctaacagtaggaactaggagacgaggctagagatcgtagaacgacgacggtccgtagtattagtgtcgagaggaagtagtacgtacgtacttcttaccgttacgttaggg

SEQ ID NO: 351555 - DNA, 557 bp, Homo sapiens
  misc_feature: GZ8MTXP02J3BX8.39.87.H10.1.454.CMB.2.raw
  modified_base (249)..(249): a, c, t, g, unknown or other
  misc_feature (249)..(249): n is a, c, g, or t
  modified_base (318)..(318): a, c, t, g, unknown or other
  misc_feature (318)..(318): n is a, c, g, or t
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
  modified_base (441)..(441): a, c, t, g, unknown or other
  misc_feature (441)..(441): n is a, c, g, or t
  modified_base (518)..(518): a, c, t, g, unknown or other
  misc_feature (518)..(518): n is a, c, g, or t
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcgagtgaaggtcctctgcaaggcttcnggaatccaccctcaccgacgtctatatgctacgtggttgcgacacggcccctaggacaagggtcttggngtggagtggatggatcgaacggtacagtgtacagaacaattncgacaacgtagtaagtttcgagggtacacgggtaccaaccgtanacgaaccgagggaccacgtcaatcaaatcagtcctanagtggactgacgcagctagacgtatacgtagaccgacgtccggacgttagtacttagttcgacggacgtaagaggtntacgtacgttactcgttactaaccgttggtttacggggg

SEQ ID NO: 351556 - DNA, 573 bp, Homo sapiens
  misc_feature: GZ8MTXP02F0UYJ.39.87.H10.1.454.CMB.2.raw
  modified_base (455)..(455): a, c, t, g, unknown or other
  misc_feature (455)..(455): n is a, c, g, or t
  modified_base (551)..(551): a, c, t, g, unknown or other
  misc_feature (551)..(551): n is a, c, g, or t
tcagtcgcactagtcacgaccggtgctcgatttagcagtactgcgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaacgccgtgggcctacgagtagaaggtcctccgtgacgaaggtcttcgtaggaactccgacccctcgaccgtacgtctatatggactacgtggttgccgacgcggccccgtaggacaagggtcttagaggtgagttggatggatacgaaccgtacagtgtctacaactaaattgcgacaagaagtacgtttacgagggcgacgggtaccaccagtacgacgaagggacaccgtactatacaaanacgacgccctaagacttagggaaacctggaacaccgaaggttcgagaagactacgtacgacgacgtaccggcgttagtatttagtgagcgagaagnttacggatactctactattagg

SEQ ID NO: 351557 - DNA, 596 bp, Homo sapiens
  misc_feature: GZ8MTXP02GDCZS.39.87.H10.1.454.CMB.2.raw
  modified_base (380)..(380): a, c, t, g, unknown or other
  misc_feature (380)..(380): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcagtgaaggtctcctgcaaggctctggaatccaaaccctcaccgacgtctatatgcactggtgcgacacggcccctggacgaagggtcttaggaggtggagtggggatggactacgaaaccggtaacaggtcggtactacgaactaaagttntacgactaacgagtaagtttacgaaggggtcaggggtcaaccgagtacgaccgagggacaccggtacaatacaaactacgacgtaccctaagagtacggaactaggacgaccgaaggccgtagaagtacgtaccgtagaaccgtacggacggtaccgttaggtattagtacgtagacgagaagtagtaggtacgtacttacttacgtacgtttagg

SEQ ID NO: 351558 - DNA, 695 bp, Homo sapiens
  misc_feature: GZ8MTXP02F5EAZ.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcagtgaaggtctctgacaaggcttcgtggaactccaccctcaccgactactatatgctacgttggtcgcgacaccggccctaggaccgaagggtcttaggaggtaggagtggggataggatacgaaacggtacgaggtcgtacctacaactaaattagcgactaacgaggttaaacgtttccgaaggggacgtaacgggtacccaaccgtaaggtaccggaaccgtaacggggaaccctaaccgtaccaattaccaaaactaccgaacgtaccctaaagacgtacggtaactagaacggacggaaggtccgtaggaatacgttacgacggaaaccgggtaccgtaccggggtaccgtttaaggtaacgtttaaggtcggtaacggacggtaacgaacggtagttaacgggtaacgtttaacctttccgtttaagttaacggtttagggggtttacggggtttaaaacgggg

SEQ ID NO: 351559 - DNA, 688 bp, Homo sapiens
  misc_feature: GZ8MTXP02ITLNN.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagcccacaggagcccactccccaggtgcagctggtgcgaggtccgggactggaggtgaagagccgtggggcctcagtgaggtcctccgtgacaggtcttgtggaactccaccctcaccgtacgtctaatagtcgctacgtggtcgccgaccgcggcccccgtggaaccgaaggggtcttaggaggtggtagtggggaatggaaactacgaaaccgggtaactggttcggtacctaacgaaacttaaaattgtacgaccaaacgtagttaaacgggttcgaagggggtcctaggggtaccaacccgtagacggaccgaaggggactacccgtactagtaacaaactacgacgtaacccttaagagtaacggacgtagaccgacgacggtagtaggaacttacgtacgtacgggtaacccgacgggtaccgggtaccgtttagttaacggttagttacgggtacggtaggtaaggggtaataaggtcggttaaaccggttactttcggtttaaccgttaaacggtttaggggg

SEQ ID NO: 351560 - DNA, 639 bp, Homo sapiens
  misc_feature: GZ8MTXP02JL6WW.39.87.H10.1.454.CMB.2.raw
  modified_base (356)..(356): a, c, t, g, unknown or other
  misc_feature (356)..(356): n is a, c, g, or t
  modified_base (377)..(377): a, c, t, g, unknown or other
  misc_feature (377)..(377): n is a, c, g, or t
  modified_base (575)..(575): a, c, t, g, unknown or other
  misc_feature (575)..(575): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagcctggggcctcagtgaaggtctcctgcaaggcttcgtggaatccacccctcacccgacgtctatatcgcacgtggttgccgacacggtcccctggaacgaagggtcttggagtgggagtgggatggatacgaaacggtaaccgngtggtctacgaactaaattancgacaacgaggttaacgttcgaggggtacgaacggggtaccaaccgtagtacggaacgaacgggtaccaccgtaccaacgtacaaacgtacacgaacctacgaagtacggaaaccgtggacgacgacgggtctagggaacgtacttcgacggaaaccgaccggtaacgggtccgtttaggttaagttaggtttacggnggaaccggtaagagtaagtacggtacttaccgttactttacgtaacgtttaggtttaacggggg

SEQ ID NO: 351561 - DNA, 569 bp, Homo sapiens
  misc_feature: GZ8MTXP02FNYU1.39.87.H10.1.454.CMB.2.raw
  modified_base (383)..(383): a, c, t, g, unknown or other
  misc_feature (383)..(383): n is a, c, g, or t
  modified_base (470)..(470): a, c, t, g, unknown or other
  misc_feature (470)..(470): n is a, c, g, or t
  modified_base (492)..(492): a, c, t, g, unknown or other
  misc_feature (492)..(492): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagagccgtggggcctgagtgaaggtctccgtgcaaggtcttcgtaggatccaccctcaccgacgtctatatgctagtggttgaccgacgacggcccctaggaccgaagggtcgttaggagtggagtgggataggactacgaaccggtaacaggtcgtactacaactaaattntacgacaacgaagtaacgtttacgacggggacgagggtacaaccgatacggaaccgagggacacgtaccatacaatacagacctaanagtagactgagacgagctaganatacgagacgtacgacggtcgtattaagttgtacgtgacgagaagagtagtacgttcgtacttacgttacgttaggg

SEQ ID NO: 351562 - DNA, 643 bp, Homo sapiens
  misc_feature: GZ8MTXP02H3T6Z.39.87.H10.1.454.CMB.2.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggacgcccactcccaggtgcagctggtgcaggtccggatgaggtgaagagcgtgggcctnagtgaaggtctcctgcaaggcttcgnggaactcacccctcaccgacgtcatatcgcacgtggtgccgacgacggccccgtggacaaggctggaggtgagtggatgatacgaaaggtactggagtactacaacgtaaattgtacgctaacgtaaaggtaacgtttaccgaaggggaccgtaagggtacccaaccgacgtacggacccgaaccggggaaccacccggtacaaacttaacaaactaacccgcgtacccaaacgtacgtacgggaaacttaggaagacgacggagagacggatacgaggaaccggaccgtacgggtaccgtagttaaattcgttagggtacgacgtaaggtagtacgttaacgtacgtttaacgttaccgttaacgtttacggttaacgggtttacggggttaacgg

SEQ ID NO: 351563 - DNA, 617 bp, Homo sapiens
  misc_feature: GZ8MTXP02I2RN1.39.87.H10.1.454.CMB.2.raw
  modified_base (198)..(198): a, c, t, g, unknown or other
  misc_feature (198)..(198): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttggccgggcaagtcagggactaattaaaatgtattagcctggtatcagacaagaaaccaagggaaaactccgtaaggtcctagatctatgatcgcctacgtaggtttaggaaaggtcggggtacccagtacgtaaggttccacggcggacaggtggtactcggtggggactagtatttcactctacacctataccacccacgccgttaggcccggtactagtaacgttatttcgacttaaactttatactgtaactaactaatttaacttctacttccgactttacgacgtttacggggacggtaaacgggaccgtaagggtaggtaagaactaaaccgtaaaacgtacgttcgtaggacctaacggaccctaaacctgttcgttcttacccttataccccg

SEQ ID NO: 351564 - DNA, 636 bp, Homo sapiens
  misc_feature: GZ8MTXP02JDAIM.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttctggaatccaccctcaccgacgtctatatgctacgtggttgcgacgacggcccctggacagggcttggagtggatgggatggatacgaacggtacaggtggtctacgaactaaattgtcggacaaacgtaaggtaaacgtttccgaagggggtaccgtaacgggggtaccaaaccgtagtacggaaacccgtaaacgggggaccctacccggtacctaaacgtaacgaaacttaccgaacggtaccctaaagacgttacggaaactagggaacgaccgaggtacgtaggaacgtactacgtagaaccggaccgtaacggtccgttagttattacgtgtacgcgtaagaagagtacggacgttacttacgtttactacgtttaagg

SEQ ID NO: 351565 - DNA, 598 bp, Homo sapiens
  misc_feature: GZ8MTXP02HCVV1.39.87.H10.1.454.CMB.2.raw
  modified_base (246)..(246): a, c, t, g, unknown or other
  misc_feature (246)..(246): n is a, c, g, or t
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
  modified_base (470)..(470): a, c, t, g, unknown or other
  misc_feature (470)..(470): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaggtctcctgcaggcttgnggaactcacccctcaccgacgtctatatcgcacgttggtgcgactcggccccgtggacgaaggtctgaggtggagtggatggatacgaaacggtanaggtgacttacgaactaaattancgacaacgtaagtaaacgtttcgaagggtcgaacgggttacaacctagtacgaaccgacggggtacaacccggttacaactaacaaactaaccacgtaccctaanaacgtaggtaactagacgacgagactaggaagatcgacgacgacgacggtcgtagtagttactagtcgacgtacgagtagtaaggtacttacgttacttaccgtaattcggttacgggtttaacgggg

SEQ ID NO: 351566 - DNA, 539 bp, Homo sapiens
  misc_feature: GZ8MTXP02GDSFN.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggctctggaatcaccctcaccgacgtctatatgcactggttgcgacaggcccctggacaaggcttgagtggagtgggatggatacgaacggtaaccagtggtactacacaaattatgacacagtaagttcgaggtcgagggtcacgatagaccagggacacgtccatacaagacacgacctacacgtaggaactgagacgaggctacgagatctagacgaacgacggtcgtagtacgttatagtacgacgtagaagaagtagtaacgttcgtacttcgtaacgttagttacggggg

SEQ ID NO: 351567 - DNA, 525 bp, Homo sapiens
  misc_feature: GZ8MTXP02FIDKO.39.87.H10.1.454.CMB.2.raw
  modified_base (354)..(354): a, c, t, g, unknown or other
  misc_feature (354)..(354): n is a, c, g, or t
  modified_base (416)..(416): a, c, t, g, unknown or other
  misc_feature (416)..(416): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggctgagtggatgggatggatcgaaacggtaacagtggtctacacaaattangcacagtaagttcgagggcagggtcaccatcgacgaggacacgtcatacaatacagcctaanagtaggaaactgagtacgagcgtagagatctagacgacgacggccgttaggtattaacgttgtagcgtaagagatgagtactcttactacgtagttgggtttaacgggg

SEQ ID NO: 351568 - DNA, 516 bp, Homo sapiens
  misc_feature: GZ8MTXP02FPBUD.39.87.H10.1.454.CMB.2.raw
  modified_base (450)..(450): a, c, t, g, unknown or other
  misc_feature (450)..(450): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaaggggcttgagtggatggggatggatcaaacgggtaacaggtggtctcaacaaattatgcacagaagtttcaggggcaggggtcaccatgaccagggacacgtaccatcaaatacagcctaacataggaactgagccaggctgagattcngaacgcaacggccgtgtattatgtgcgagagagtgagttaactcttatactagtgggtttacgggg

SEQ ID NO: 351569 - DNA, 638 bp, Homo sapiens
  misc_feature: GZ8MTXP02GSTI1.39.87.H10.1.454.CMB.2.raw
  modified_base (245)..(245): a, c, t, g, unknown or other
  misc_feature (245)..(245): n is a, c, g, or t
  modified_base (359)..(359): a, c, t, g, unknown or other
  misc_feature (359)..(359): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcgtgcaggctcnggatccaccctcaccgacgtctatatgaccacgtgggttcgaccgaccgacggcccccgtaggaaccgaaggggtcttaggaggtggagtggggatggatacgaaacggtaacncggtggtactacgaataattatcgcaacaaggtaacgttcgagggcgtagggtcaccgagtacgacgaaggacacgtacagtacaaactacgacgtaccaacgtagtaagggaactaggagtaccggaggtaccgtaggtaagtacgtacgtacggggaaccgacggtaccgggtaccgttaggttactttacggttggtaacggacggaaggaaggtagtaacggtaacggttacttacgtttaccgttacggtttaggttacgggggtttaacgggg

SEQ ID NO: 351570 - DNA, 607 bp, Homo sapiens
  misc_feature: GZ8MTXP02IXVX0.39.87.H10.1.454.CMB.2.raw
  modified_base (224)..(224): a, c, t, g, unknown or other
  misc_feature (224)..(224): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (445)..(445): a, c, t, g, unknown or other
  misc_feature (445)..(445): n is a, c, g, or t
tcagtcgcactagtcacgaccggtgctcgatttagcagtactgcgttggggtttgggggagtcagacccactcaggacacagcatggacatgagggtccccgctcagctcctggggcttctgctgctctggctcccaggtgccagatgtgccatccagttgacccagtctccatcctcctgtctgcatctgtaggagacagatcaccatcacgttggccggganaagtcgaggactaaattaaaatgtaatttacggcctaggtatcaagacaaagaaaaccgaagggaaaacctccgtaaaggtcctagactactatgactcgaccttacgtaaggtttagggaaacggttcggggtaccctagtacgtaaggttccgaggcggcaggtggatcggtgggactagtacttcactcacacatccacncgcngcgactagtaattntttacgacttaattattacgtataacttaattaatttacgttctactccgtacttcgtaccggttcgggacggtaacggaacgtaaggggtacgtaaagtaactaacgaaacggtagtcggtacgtacgaaccgtacacttcgtacttcgtaccttcttacc

SEQ ID NO: 351571 - DNA, 589 bp, Homo sapiens
  misc_feature: GZ8MTXP02GH0D8.39.87.H10.1.454.CMB.2.raw
  modified_base (251)..(251): a, c, t, g, unknown or other
  misc_feature (251)..(251): n is a, c, g, or t
  modified_base (367)..(367): a, c, t, g, unknown or other
  misc_feature (367)..(367): n is a, c, g, or t
  modified_base (494)..(494): a, c, t, g, unknown or other
  misc_feature (494)..(494): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggagggtgaagagccgtggggcctcgagtgaggtctcctgcagctnggaatcacctcacgctctatatgcacgtggtgcgacacggcccctggaacgagggtcttaggaggtggagtgggatggatacgaaccggtaacaggtgtactacaactaaatttgngaccaagacgttaagtttcggaggggtacgaacgggtcaaaccgagtacgaacccgaaggggaacctaccgtacaagtacaaataaccgagaaccctacaaggttacgaactagagaaccgagggtnaacggtagactgagaaccgacggtaccggcgttataacttagtacgtagacgaagaagtagtaggtaaacgttctacgttacgtacgttaaaggg

SEQ ID NO: 351572 - DNA, 524 bp, Homo sapiens
  misc_feature: GZ8MTXP02JQBTW.39.87.H10.1.454.CMB.2.raw
  modified_base (362)..(362): a, c, t, g, unknown or other
  misc_feature (362)..(362): n is a, c, g, or t
  modified_base (427)..(427): a, c, t, g, unknown or other
  misc_feature (427)..(427): n is a, c, g, or t
  modified_base (493)..(493): a, c, t, g, unknown or other
  misc_feature (493)..(493): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctctgcaggcttcgtggaactcaccctcaccgacgtctatatgcacgtggttgcgacacggcccctggacagggctggagtggagtgggatggatcgaaccggtacagtggtactcaactaaattntgacaagagtaagttcgagggcgaggtcacgatcgacgaggacaccgtcatacatacagacctanagtgaactggacgcgaggcgtagagactcgtagacgacgacgtcgtagtacttagtgacgtgaagngagtacgtacgtacttcttactacgtttagg

SEQ ID NO: 351573 - DNA, 596 bp, Homo sapiens
  misc_feature: GZ8MTXP02G43VI.39.87.H10.1.454.CMB.2.raw
  modified_base (256)..(256): a, c, t, g, unknown or other
  misc_feature (256)..(256): n is a, c, g, or t
  modified_base (284)..(284): a, c, t, g, unknown or other
  misc_feature (284)..(284): n is a, c, g, or t
  modified_base (379)..(379): a, c, t, g, unknown or other
  misc_feature (379)..(379): n is a, c, g, or t
  modified_base (461)..(461): a, c, t, g, unknown or other
  misc_feature (461)..(461): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagagccgtgggcctcgagtgaaggtctccgtgacaaggtcttcgnggaactccaccctcaccgacgtctatangcacgtggtcgcgacgcggcccctggaccgaaggtcttaggagtgggagtgggatggatacgaacgtacgtaggtcgtactacaacgaaattcgngacacgaagtagttcgaagggcagggtacacgagtacgaccgaggggaacctacggacctataacgaataccacgtacctanacgtaggaactggagacgtacgntagagtntcgacgacgaccgacggtaccgttagtagttacgtggtacgacggaagttacggaagttcgtaaacgttacgttacgttaccgttacggttaggtttaacggggg

SEQ ID NO: 351574 - DNA, 683 bp, Homo sapiens
  misc_feature: GZ8MTXP02IVBM4.39.87.H10.1.454.CMB.2.raw
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtgggcctcgagtgaaggtctctgcaaggcttcaggactcaccctcacccgagtctatatgactacgtggttcgacgacaccgggcccctggaacgaagggcttaggagtggagtgggatggatacgaaacggtaccgagtcggtacacgaaactaaattgtcgaccaacgtaaggtaaacgtttcgaaggggtacgtaacggggtacctaaccgaagttacggaaccggtaaacggggtaaccctaaccggtacctaacgtaactaaaaccgttaaccgaacgtaacccttaaacgacgttaacgggaaacgttccggaagggacccgaagggttaccgacgaaaggtacgttaccgtaacgggaccgtaacggtaaccgggtccgttaaggttaccgttaagttcggacgtaacgaggtagtaagtagtacgttaacccttgttaacgtacggttagtttaacggggg

SEQ ID NO: 351575 - DNA, 694 bp, Homo sapiens
  misc_feature: GZ8MTXP02H9NGL.39.87.H10.1.454.CMB.2.raw
  modified_base (305)..(305): a, c, t, g, unknown or other
  misc_feature (305)..(305): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggacgcccactcccaggtgcagctggtgcgaggtccggactggaggtagaagaagccgtggggcctcgaggtgaaggtctcctgacgtaaggtcttcgtaggaactccacccctcacccgacgtctaatatcgctacgtggttcnccgacgacggccccgtaggacgaagggtcttggaggtggagtgggataggacgtacgaaacggtagacggtcggtacctacgaaacttaaagtttacgcggtactaacgggtaaagttaaacgtttaccggaaggggtaccggtaaacgggttacccaaaccccggtaaggtaacccggaacccgggaaacggggtaaacccgtaaccgtaccccgtaaataaccgtaaaaccttaccgacgtttaacccgaagtacggtaacggtaacgtaggaacgaccgaggtacgtagacgagtcgtacgaccgtacgtaacggtcgttagttatacttggacgacgtaggatacgtgtaacgtcttacgtactacgttaggttacggttaacgg

SEQ ID NO: 351576 - DNA, 779 bp, Homo sapiens
  misc_feature: GZ8MTXP02F4N9Q.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcgagtgaaggtctcctgcaggtcttgtggaactccacccctcacccgacgtctatatcgactacgttggtcgaccggacgaccgggtccccgtagggaaccgtaacggggtctttaggaggtagggaggtggggattagggaactaccggaaaacggtaaccgtaggttcggtacctaacaaacttaaaatttcgcgacctaaagtaaaggtttaacgttcgggaacgggggtaccgtacgggggtacccaacgtaacggtaccggaaacccggtaacgggggtaaccctaacccggtaccctaaacgtaaccttaaaacgtaaccgaaccggttaacccgttaaaccgaagggttaaaccgggaaaccgttacgggaaggacccgaaggggtacgtaaggtaacgtaacgttaccggtaacggaaaccgaaccggttacgggtaccgtttaggttaaacttttaggtcgggttacggaacggttaacgaggtaaagtttacggtaacgttttaacctcgttttaaccgtaacggtagggtttttaacggggg

SEQ ID NO: 351577 - DNA, 636 bp, Homo sapiens
  misc_feature: GZ8MTXP02HX8ZB.39.87.H10.1.454.CMB.2.raw
  modified_base (377)..(377): a, c, t, g, unknown or other
  misc_feature (377)..(377): n is a, c, g, or t
  modified_base (437)..(437): a, c, t, g, unknown or other
  misc_feature (437)..(437): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagcaacaggtgcccactcccaggttcaattggtgcagtctggagctggcggtagaaggaggccgtggggcctcgagtgaacgtctctgcgaaggtcttcgtgttactactttagcgtagttagtggtgtcaggcgtgggtgcgacgacggccccgtaggacgaaggtcttggagtggagtgggagtggatcgagctaactaacaagtagaaaacacaaaagtanagacaactaattaaacgttaccgaaggggacaagtagtacaactagaatacgaaaccaanaacgtacaacacgtaccacgaacgactaccgtacgacccttaagaacgttaacggaaccgtaaggaacggaaaccgtgtaaacgtacacgtaacgaaaccggtacgaccgtttactttaaactttaggtatttacgacggtaagaagaaacgtaacttaaaccttttccgaaacgtttaaactactttaaacggtaacg

SEQ ID NO: 351578 - DNA, 606 bp, Homo sapiens
  misc_feature: GZ8MTXP02GR6FC.39.87.H10.1.454.CMB.2.raw
  modified_base (251)..(251): a, c, t, g, unknown or other
  misc_feature (251)..(251): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgccagctggtgcagtccgggactgaggtgaagaagcctggggcctgagtgaaggtctcctgcaaggcttcgnggaatccaccctcaccgacgtctatatgctacgtggttgcgacacggcccctaggacgaaggcttggagtgggatggggatggatacgtaaacggtaaccgagttgtactacaactaaaattatggacaaacgtaaggtaaacgtttcgaagggtacgaacggggttcaaacccgtagtacgaaccgaagggaaccacggtaccaagacaaatacgatacctaacgtagtacgaacgtgaaggctaacggcgtagaagacttcgagaaccgacgaccggtaccggtattacgttagttcgtacgacgagagtaagagtaacgttactaccgttacgtaacgttaggtttacgggg

SEQ ID NO: 351579 - DNA, 551 bp, Homo sapiens
  misc_feature: GZ8MTXP02IBZK3.39.87.H10.1.454.CMB.2.raw
  modified_base (226)..(226): a, c, t, g, unknown or other
  misc_feature (226)..(226): n is a, c, g, or t
  modified_base (363)..(363): a, c, t, g, unknown or other
  misc_feature (363)..(363): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccggnaagtcagggcaattaaaatgtattagcctaggtatcagacaagaaaccagggaaaacctccgtaaggtcctagatctatgatcgcctcgtagttggaaagtcggggtaccagtccgaaggttcaggcggcaggtggngtcgtagggactagtatttcacttctacaccactccacagccctgccgctagagtactttgacttaactttatactgtacctaactaatttacttcttactctcttctaacgttcggggacggtaacggaccgtaggaggtacgactacgaaaacgcttaggcgtcacgaccactctacttcgttacc

SEQ ID NO: 351580 - DNA, 634 bp, Homo sapiens
  misc_feature: GZ8MTXP02IV4WR.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttcgacccagtcctccatcctccctgtctgcatctgtagagacagatcaccatcacgttggccgggacaagtcgagggactaaattaaaatgtaattagtacctaggtatacagacaagaaaccgaaggaaacctccgtaagtcctagatctatgactcgcctcgtaggtttaggaacgtcgggtacctagtacgtaacggttcacggtccgacgtaggtagacgttacggtaggggaactaggtactttccaaccttcgaacctacctactaccacccgacgtccctgggtaccgtacgtagtaaagttctttacgacttaacgtttattacgtactacttaaattaaatttacttacctaagtccctacgttacgtaacggtttcggacgggtaagggacctaaaggggtcgaaatacgtaaacgaaacgttacgtaggtcgcgtcgactacctagtctacgtttcctactaccc

SEQ ID NO: 351581 - DNA, 578 bp, Homo sapiens
  misc_feature: GZ8MTXP02JRNJ1.39.87.H10.1.454.CMB.2.raw
  modified_base (252)..(252): a, c, t, g, unknown or other
  misc_feature (252)..(252): n is a, c, g, or t
  modified_base (372)..(372): a, c, t, g, unknown or other
  misc_feature (372)..(372): n is a, c, g, or t
  modified_base (453)..(453): a, c, t, g, unknown or other
  misc_feature (453)..(453): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcagtgaaggtctctgcaggcttcgnggaatccaccctcaccgtacgtctatatgcagtggttgcgacacggcccctggacaaggcttaggaggtggagtgggatggatacgaaaccggtacaggtcggtctacgaactaaagttntgacacgtagtaacgtttacgagggcgagggtccaacgagtcgaccgagggacacgtcaatacgactacgacgtacctaanagtaggacctagggacgcgaaggtcgtaggacgtagtacgtagaaccgacgtaccggtcgtacgtagttacgtaggtcgacgagaagaagttggtaacgttccttacttaccgtacgtttacggg

SEQ ID NO: 351582 - DNA, 750 bp, Homo sapiens
  misc_feature: GZ8MTXP02JYE7B.39.87.H10.1.454.CMB.2.raw
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggacgcccactcccaggtgcagctggtgcaggtccggatggaggtgaagagccgtggggcctcgagtagaaggtcctccgtgacgaaggtcttcgaggaactccacccctcaccgacgtctatatgctagtggttcgacgaccgaccggccccgtggaaccgaagggtcttaggaggtagggagtaggggagtacgggtaataccggaaacccgggtaacgtaggttcgggttacctacgtaaaaccgttaaagtttagtcgaacctaaagtaaacgttaacgggtttacccggaagggggtaccggtacgggggttacccaaacccggtaaggttaccggaaacccggtaaagggggaaccctaaccggtaaccccgtaaataacctaaaacgtaccgaaaccggtacctaaacgtaagtacgggaacctaggacgtacggacgggtactaggaaacgtcgttacgaacgtaaccggaccggaaccgggttccgttaaggttaactttaggttaccgaggaccggtaagaaggttacgtaacggttacgttacccttacgtttaccgttaaggtttaaccgggg

SEQ ID NO: 351583 - DNA, 624 bp, Homo sapiens
  misc_feature: GZ8MTXP02GPHXJ.39.87.H10.1.454.CMB.2.raw
  modified_base (257)..(257): a, c, t, g, unknown or other
  misc_feature (257)..(257): n is a, c, g, or t
  modified_base (369)..(369): a, c, t, g, unknown or other
  misc_feature (369)..(369): n is a, c, g, or t
  modified_base (489)..(489): a, c, t, g, unknown or other
  misc_feature (489)..(489): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcaggtccgggatgaggtagaagagccgtggggcctcgaggtggaaggtctccgtgacgaggtcttgnggaactccaccctcaccgtacgtctatatgctagtggttcgcgacgacggtccccgtaggaacgtagggtcttggaggtagggaggtgggtataggatacgaacggtaaccnggtacgtactacaacttaattatcgacaacgtaggtagttcggagggtacgagggtaccacgtagacgacgacggacacgtacacgtaactaacacacgtaccaactacgtacgtaacgngaggtccgaaggtctaggacgacttcggaacgacggaaccgtaccgggtacgttagtttacgttacggtaggtacgacggtaggtaagaagttacggtagttaccttacgtacgttaacgtcgggtttaacgggg

SEQ ID NO: 351584 - DNA, 610 bp, Homo sapiens
  misc_feature: GZ8MTXP02GM1O2.39.87.H10.1.454.CMB.2.raw
  modified_base (247)..(247): a, c, t, g, unknown or other
  misc_feature (247)..(247): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggacgccccactcccaggtgcagctgtgcaggtccgggactggaggtgaagagccgtgggcctgagtgaggtctctgcaggcttcgngaatccaccctcacccgacgtctatatcgctacgtggtgcgaccgacggccccgtggaacgaggtcttggaggtggagtgggatggactacgaaacggtagagtcgtctacaataaattagcgcagaagtagttcgagggactacgggtacaacgtagtacggaccgaggacacgtcgaactacaaacgtacgacgtacctaacgagttaggaaacgtgaacggacgaggtcgtaggaacgtacgtacgtacggaaccgtaccgtacgggtaccgttagttagtttaggttacggacggacggtaaggagtagtaagtacgttacttccgttacgttacggttaggtttacggggtttaaagg

SEQ ID NO: 351585 - DNA, 572 bp, Homo sapiens
  misc_feature: GZ8MTXP02I7FPK.39.87.H10.1.454.CMB.2.raw
  modified_base (250)..(250): a, c, t, g, unknown or other
  misc_feature (250)..(250): n is a, c, g, or t
  modified_base (361)..(361): a, c, t, g, unknown or other
  misc_feature (361)..(361): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcagtgaaggtctctgcaggctcnggatcaccctcaccacgtctatatgcatggttgcgacacggcccctggaccaagggtcttgagtggagtgggatggatacgaacggtaacagtgtactacgaactaaattngacacgtaagtaagttcgagggcagggtcaaccgatacgaaccgtagggaccaccgtaccaagtaccaaactacacgacctaacgaagtacggaaactggaacgacgacggtacaggaagtactacgacgaacgaccgacggtaccgttacgttagttacgtcggtagacgaagtaagtagtgtaacgtacttcgttacgtacgtttaggg

SEQ ID NO: 351586 - DNA, 666 bp, Homo sapiens
  misc_feature: GZ8MTXP02GTQ4C.39.87.H10.1.454.CMB.2.raw
  modified_base (374)..(374): a, c, t, g, unknown or other
  misc_feature (374)..(374): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcgaggtccgggactggaggtagaagaagccgtggggcctcgagtagaaggtcctccgtgacgaacggtcttcgtggaactccaccctcacccgtacgtctatatcgcacgtggttcgcgacgacggccccgtaggacgaaggtcttggaggtggagtgggagtaggactacgaaacggtaanaggtcggtacacgaataaattgtcgacgtaaacgtagtaacgtttcgacgggtacgacgggtacaccgagtacggaacggtacggacgaccgtacacgtaacgaactaacgtacgacctaaacgaacggttacggaaaccgttaggacggacaacgggtacgttaggaacgtaagtcgtaacggaaccgaacggtaccgggcggtttacgttaatttaacgtggttaacggacgaggtaaaggtacgtacggttaacgttaccgttaactttccgttaaacgtttaaggggg

SEQ ID NO: 351587 - DNA, 589 bp, Homo sapiens
  misc_feature: GZ8MTXP02F0UZ1.39.87.H10.1.454.CMB.2.raw
  modified_base (362)..(362): a, c, t, g, unknown or other
  misc_feature (362)..(362): n is a, c, g, or t
  modified_base (551)..(551): a, c, t, g, unknown or other
  misc_feature (551)..(551): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacaggcccctggacaagggcttgagtggagtgggatggatacgaacggtaacagtggtctacgaaactaaattntgactaaacgaagtaagtttacgagggtacgaaggggtaccaaccgtagtacgaaccgaagggaaccaccgtaccaatacaaaactacgaacgaccctaacaacgttacggaacgttaggacgaccgaggtacgtagaacggtactacgtacgaacgaaccgacggtaccgtagttattagtcgtacgngaagaagtataggtaactacttacttacgtagttaagg

SEQ ID NO: 351588 - DNA, 588 bp, Homo sapiens
  misc_feature: GZ8MTXP02F21N8.39.87.H10.1.454.CMB.2.raw
  modified_base (336)..(336): a, c, t, g, unknown or other
  misc_feature (336)..(336): n is a, c, g, or t
  modified_base (473)..(473): a, c, t, g, unknown or other
  misc_feature (473)..(473): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacagcccctggacaagggcttggagtggagtgggatggatcgaaacggtaanacggttaggtcctacgaactaaaattattagccaacaagtaagttttaccgaggggtacgaggggtaccaccgagtcgaacccgagggtaacacgttaccaattacaaattacacgcctaaaccgattacggaacgngacgacgaggaccgttgaaggacttacgaggaacgaccgacgggtccgttagtaatttataggtcgacgtagagtaatgtaagtactctttaccacgtagttcggggtttaaggg

SEQ ID NO: 351589 - DNA, 585 bp, Homo sapiens
  misc_feature: GZ8MTXP02HUJ3J.39.87.H10.1.454.CMB.2.raw
  modified_base (283)..(283): a, c, t, g, unknown or other
  misc_feature (283)..(283): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctccgtgcaaggcttcgtggaactccaccctcaccgacgtctatangcacgtggtgcgacgacggccccgtaggaccgaagggtcttggaggtggagtgggagtggatacgaacggtaacagtggtactcaacgtaaattgtagacacgaagttaacgttcgaagggtacgaggggtacaaccgagtacggaaccgaagggacaccgtacaacgtacaaactaacaacgaccttaacgagttacggaactggacgacgaggcgtaggagacgtacgacgacgacgacggtcgtagttattagtgtacgacggagaagtagtagtacgtacttcttaccttagtttagg

SEQ ID NO: 351590 - DNA, 587 bp, Homo sapiens
  misc_feature: GZ8MTXP02I2SDQ.39.87.H10.1.454.CMB.2.raw
  modified_base (504)..(504): a, c, t, g, unknown or other
  misc_feature (504)..(504): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgagtctcctgcaggcttctggaactccaccctcaccgacgtctatatgctacgtggttcgcgacacggtccccctggaacgaagggtcttggaggtgggagtgggagtggatacggaacggtaacgagtggtactacaacgtaaattagtcgacctaacgtaggtaagtttaccgaaggggcgtaacgggtaccaccgtagtacgaaccgacggggacctaaccggtcccaaatacaactacgacgtacctacagtagaactgacgacagtcagagntcgagacgactacggcgtatacgtagtggtacgacgtagagtaagtgtacgttactaccgttacgttacgtagtttacggggg

SEQ ID NO: 351591 - DNA, 643 bp, Homo sapiens
  misc_feature: GZ8MTXP02JZI65.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcagtgaaggtctcctgcaaggcttcgtggaactccaccctcaccgacgtctatatgcacgtggtgcgacgacggccccctggacgagggtcttggaggtagggagtgggagtggatacgaaacggtacgtaggttcggtctacgaataaattgtgaccaacgtagtaacgtttacgaggggtacgacggggtccaaccgtagtacggaaccgacggggaacctaccggtacccaaactacgaaataccgacgacccgtaacacggtacggtaactaggacgacgacggacgttagacgtactccgtacggaaccgaccggtaccggtaccgttagttacgtttaagttcggtaggaccggtaagtaggtaagttaggtaccgttactttcgtacgttaccggttaggtttacggggg

SEQ ID NO: 351592 - DNA, 644 bp, Homo sapiens
  misc_feature: GZ8MTXP02JYYN1.39.87.H10.1.454.CMB.2.raw
  modified_base (227)..(227): a, c, t, g, unknown or other
  misc_feature (227)..(227): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttcgacccagtctccatccctccctgtctgcatctggtaggagacagagtcaccatcacgttggccgganaagtcgaggactaaattaaaatgtaattacgccgttaggtatacgagacaacgaaaaccgaacggtaaaacctcgtaaacgtcctagtatactagtgactcgtacctacgtaggttacggaacggtcggtaccaagtcgacgtccaggcgngagtggatcgtgggtaacagttactactactacctacaccgtactacgaaccgtcgtcccgnggtccgtacgtagtaagttacttagacttaacttacgtactaacgtactaaatttaaactttcttacttacgccgttacttacgtacgggtttcgggaaccggtaaggtaaccgtaggtaacggtaataacgtaaaccgaaacggtacgtacggtcggtactaacgacccctaagtccgttacgtccgttacctacttaccccg

SEQ ID NO: 351593 - DNA, 574 bp, Homo sapiens
  misc_feature: GZ8MTXP02GIOXF.39.87.H10.1.454.CMB.2.raw
  modified_base (253)..(253): a, c, t, g, unknown or other
  misc_feature (253)..(253): n is a, c, g, or t
  modified_base (327)..(327): a, c, t, g, unknown or other
  misc_feature (327)..(327): n is a, c, g, or t
  modified_base (361)..(361): a, c, t, g, unknown or other
  misc_feature (361)..(361): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttcnggaatcaccctcaccgacgtctatatgcacgtggtgcgacacggcccctggacaagggcttgagtggatggganggatcgaacggtacagtggtctacgaacaaattntgacaacgtagtaacgtttcgagggactagggtaccaaccgagtacgaaccgagggaacaccggtacaagtacaaactacgaacgtaccctaaagagttacggaactgggaacgacgaggtcgagacgtactcgtagaaccgacgacggtaccgttagtattagtgtacgagaagaacgtagtacgtacgtaccttactacgtactttagggg

SEQ ID NO: 351594 - DNA, 713 bp, Homo sapiens
  misc_feature: GZ8MTXP02JIUP4.39.87.H10.1.454.CMB.2.raw
  modified_base (198)..(198): a, c, t, g, unknown or other
  misc_feature (198)..(198): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttcgacccagtctccatcctcctgtctgcatctggtaganacagacgtcaccatcacgttcggccgggactaaggtcgaagggtactaaattaaaaacgtgtaatttacgccgtaggtactacgagacaaacggaaaccgaagggtaaaacctccgtaaacggtcctagacttacgtatgactcgaccttacgtaagggtttacgggaaacggttcggggtaaccctaagtaccggtaaaggttccgaagggtccggacgtacggggttaggtaacgttaccggtcgggggaaaccttaaggttaccttttacccaacctttcctacccaaaccctacgttcccaaacccgtacgtcccggttacggacccgtaccgttaaggtaaacgtttacttttagaaccttaaacgttttactaccgttataaacctaaattaaacttttacttctactaccgtcttacgtacgttcgggacggtaagaaccgtagggtagacgtaactacgaaaacggtgttcgtcggactgacctacgtacttcggtactactctacc

SEQ ID NO: 351595 - DNA, 679 bp, Homo sapiens
  misc_feature: GZ8MTXP02JRUVB.39.87.H10.1.454.CMB.2.raw
  modified_base (249)..(249): a, c, t, g, unknown or other
  misc_feature (249)..(249): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtccggactgaggtgaagagccgtgggcctcgagtgaggtctctgcaggcttcgngaatccaccctcacgacgtctatatgcacgtggttgccgtacgacggccccgtaggaacgagggtcttaggagttggaagtgggatggatacgaaaccggtacagtcggtactacaactaaattgtacgactacgtaaagtaacgtttacggaggggtcgtaagggtccaaccgaagtacggaaccgaacggggacctaccggtaccaaactaccgtaaataaccgaacgtacccttaaagacgttaacgggaacttaggaccgacgaacggacgttaggaaacgtacgttacgtacggaaccgtaaccgggtaccgggttaccgttaaggtttacgtttaacggtttaggtaccggtacggaaacggtaagtaagttacggtaaacgtttaccgtttacggtttaccgtttaaacgggttttaacgggg

SEQ ID NO: 351596 - DNA, 655 bp, Homo sapiens
  misc_feature: GZ8MTXP02IW657.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcgaggtccgggactggaggtagaagaagccgtggggcctcgaggtgaggtctccgtgcgaaggcttctggaactccaccctcaccgcgtctatactgctacgtggtcgcgacgtaccggccccgtaggacgaggtctaggtaggtggagtgggatggaatacgaaccggtacagtcgtactacgtaactaaattgagtacaagtaaggttaagttcggaggggtacgaacggggtacaccgtagtaccgaaccggaggtaaacccgtacggtaacctaagtacctaaacgtacgaaccgtacctaaaccgtaagtaacggaaccgtagacgacggtacggtacgtagaacgtattaccggacgaaaccgtaccggtaacggttaccgttaggttacgttaacggttgacggtagaggtaagtgtaacggtacttaacgttcgtttacgttacgtttaacgggg

SEQ ID NO: 351597 - DNA, 560 bp, Homo sapiens
  misc_feature: GZ8MTXP02IRKN2.39.87.H10.1.454.CMB.2.raw
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (435)..(435): a, c, t, g, unknown or other
  misc_feature (435)..(435): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaataagcctggggcctcagtgaaggtctcctgcaaggcttctggaatccaccctcacccgacgtctatatgctacgtggttcgcgacacggcccctaggacaagggcttggagtggatggggatggatcgaaacggtaacnggtgtctacaactaaattangcaacgagtaacgtttcgagggcaggggtcacgatcgacgaggacacgtacatacaatacagacctaanacgtaggaactaggacgcgagcgtagagatcgtagacgacgacggtccgttagttattagttgtacgacgagtaagtagtaagtacgtacttacttactaacgttacggttacgggtttaacggg

SEQ ID NO: 351598 - DNA, 594 bp, Homo sapiens
  misc_feature: GZ8MTXP02HVZ50.39.87.H10.1.454.CMB.2.raw
  modified_base (482)..(482): a, c, t, g, unknown or other
  misc_feature (482)..(482): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccggactgaggtgaagaagccgtgggcctcgagtgaaggtctcctgacaggtcttcgtaggaactccaccctcgaacccgtacgtctatatgctacgttggtcgcgacgacggcccctggaacgaggtcttggagtgagtgggatggtactacgaacggtacagtgtctacaataaattagtcgactaacgaagtacgtttacgacggggtacacggggtaccacgaagtacggaccgagggaccctacgtaccaatacaactacacgtacctaacagtacggtaacnggagacgagtagacgtagactacgacgacgaccgtacggtacgttgttaaacgttgtagtacgacgagagtaacgtagtacgttacgtcttacgtacgtttaggttacgggg

SEQ ID NO: 351599 - DNA, 599 bp, Homo sapiens
  misc_feature: GZ8MTXP02GMV06.39.87.H10.1.454.CMB.2.raw
  modified_base (494)..(494): a, c, t, g, unknown or other
  misc_feature (494)..(494): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagccgtggggcctcgagtgaaggtctcctgcaaggcttcgtggaatccaccctcaccgacgtctatatcgcacgttggttcgccgacgacgggccccctaggaaccgaaggggctttaggaggtagggagtggggatggatacgaacggtaacgagtggtactacgaactaaattatcgacaacgtaagtaacgtttcgaggggtacgacgggtacaacgagtacgaaccgagggaccacgtacatacaatacagaccagacgtagaactaggagacacggntacggaagtacgtacgtagaaccgaacgacggtccgtagttacttagtggtcgacgtaggagtaacgtagacgttactacgtttactaacgtagtttaacggggg

SEQ ID NO: 351600 - DNA, 606 bp, Homo sapiens
  misc_feature: GZ8MTXP02GRVHD.39.87.H10.1.454.CMB.2.raw
  modified_base (225)..(225): a, c, t, g, unknown or other
  misc_feature (225)..(225): n is a, c, g, or t
tcagtcgcactagtcacgaccggtgctcgatttagcagtactgcgttgggtttggggggagtcagacccactcaggacacagcatgggacatgagggtccccgctcagctcctggggcttctgctgctctggctcccaggtgccagatgtgccatccagttgacccagtcctccatccctcctgtctgcatctgtaggagacagagtcaccatcacttggccggnaagtcaggactaattaaaatgattagctaggtatcagcaagaaaccgagggaaactccgtaaggtcctagattctagtagatcgtcctacgtaggtttagggaaggttcgggtaccagtacgtaaggttccaggcgacgtaggtggattcgtggggacagtacttcactctacactatccacctagccgtacgcggactgaagttactttagacctaattacttactagttactaaacttaattttaattccttaactcccgtacttaccgtacggtttccgggacgggtacggaaacccgtagggtaggtaaagacttaaacgaaaacgtacgtacggtaggcctaagaccctaacgtacgtctacgttcttacttaccg

SEQ ID NO: 351601 - DNA, 565 bp, Homo sapiens
  misc_feature: GZ8MTXP02G7I6I.39.87.H10.1.454.CMB.2.raw
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (262)..(262): a, c, t, g, unknown or other
  misc_feature (262)..(262): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggacgcccactcccaggtgcagctggtgcgagtccgggatggaggtgaagagcgtgggcctgagtgagtcnctgnagctngatcacctcaccgacgtcatangcacgtggtgacgacacggccctaggacaagggtctaggagtggagtggatggatacgaaacggtanacgtgactacaataaattngacaagtaagtaacgtttcgagggtacgaggtaccaactagtacggaaccgaaggggacaccggttaccaactacaaaacgtaccacgtacctaacagtaggaactagacgacgagcgtagaagactacgagaacgacgaccggtcgtagttattacgtaggaggacgagaagtacgtaagtacttacctatactacgtacggtttaggtttaacgg

SEQ ID NO: 351602 - DNA, 646 bp, Homo sapiens
  misc_feature: GZ8MTXP02HIDCR.39.87.H10.1.454.CMB.2.raw
  modified_base (258)..(258): a, c, t, g, unknown or other
  misc_feature (258)..(258): n is a, c, g, or t
  modified_base (368)..(368): a, c, t, g, unknown or other
  misc_feature (368)..(368): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagacgcgtcgggctgagtgagtcctctgacgagtcttgaggtaacnccaccctcaccgacgtactatatcgctacgttggtacgacgaccgaccggtccctaggacgtaacggtcgtggaggtaggagtgggatggacgtacgtaaacggtaacgnggtacgtacgtaacaaacttaaattgacgacaaaccgtaaagttacgtttacgggaagggtccgggtaacggtaccaaaccgtacgtaaccgggaaccgtaacgggaacctacccggtactaacgtaacctaaacgaccgtaacgaccgttaacgaacggttacgacgtaacggagaaccggagtcgtagacgtacgtacgacggacgacgtacggtccgttagtacgtagttcgacgagtagaagtatcgaacttctaccgtattacgttaacgggg

SEQ ID NO: 351603 - DNA, 634 bp, Homo sapiens
  misc_feature: GZ8MTXP02I0JSY.39.87.H10.1.454.CMB.2.raw
  modified_base (389)..(389): a, c, t, g, unknown or other
  misc_feature (389)..(389): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcaggtccggatgaggtgaagagcgtggggcctcgagtgaaggtctccgtgcaaggtcttcgaggaactccaccctcaccgtacgtctatatcgactacgtggtcgacgacgaccgggtcccctaggaaccgaagggtcttaggaggtggagtgggatagggactaacgaacggtacaggttcgtctacaactaaatttngtacaaacgagttacgttacgaggggacaggggtacacgtagacgacggacggactaccgtacaatacgaactaacacgtaccaacgtagaccggtaagtacgaggaccgaaggtaccgtaggaacgaagttacgaacggaacgaccggtaaccggtacgtttaaggttactttaggtcggttacggacgtaggaagtaagtaggtaacttaccgttatttaacgtacgtttacggtttaggggg

SEQ ID NO: 351604 - DNA, 620 bp, Homo sapiens
  misc_feature: GZ8MTXP02IWWRP.39.87.H10.1.454.CMB.2.raw
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcgagtgaaggtctccgtgcgaaggtccttcgtggaacttccgacccctacaccggtacgtctatactgaccacgtggttcgcgacgaccgggtccccctaggacgaagggtcttggaggtgagtgggagtgatacgaacggtacagtgtactanaactaaattgngacaacgtaaggtaagttcgaggggtacaggtacacagtcgaaccgacggacacgtccatacaactacacgacctaacgtagacgtaactggacgacgagctaggactacgttcgacgtaccgaacgtaccgggcgttaagtacgtttagtacggtggaccgtaaggtaagtaaccgttaggtaacgttacccgttcgttaccgttaaggtttacggtttaaccggggg

SEQ ID NO: 351605 - DNA, 577 bp, Homo sapiens
  misc_feature: GZ8MTXP02GNHZJ.39.87.H10.1.454.CMB.2.raw
  modified_base (244)..(244): a, c, t, g, unknown or other
  misc_feature (244)..(244): n is a, c, g, or t
  modified_base (357)..(357): a, c, t, g, unknown or other
  misc_feature (357)..(357): n is a, c, g, or t
  modified_base (539)..(539): a, c, t, g, unknown or other
  misc_feature (539)..(539): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtgggcctcagtgaagtctctgcaaggcttntggatcaccctcaccgacgtctatatgctactggttgcgacacggcccctggaacaagggcttggagtggatggggatggatacgaacggtaaccagtggtcacactaaattntgcaagtagtagtttcgagggcagggtaccacgtatacgaccgaagggtacgaaccggttaccaagtacctaaataccaacggtacctaacgtagtacgggaaacgtcggaaggccggaaggacgtagaagtacgtaccgtaggaccgaacgaccggtccgtagttattagtcgtgacgagngaagtagagttactcgttactaacgtaggtttacgggg

SEQ ID NO: 351606 - DNA, 520 bp, Homo sapiens
  misc_feature: GZ8MTXP02HQ2V4.39.87.H10.1.454.CMB.2.raw
  modified_base (248)..(248): a, c, t, g, unknown or other
  misc_feature (248)..(248): n is a, c, g, or t
  modified_base (353)..(353): a, c, t, g, unknown or other
  misc_feature (353)..(353): n is a, c, g, or t
  modified_base (383)..(383): a, c, t, g, unknown or other
  misc_feature (383)..(383): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctgggcctcagtgaaggtctcctgcaaggcttnggatcaccctcaccgcgtctatatcgctacgtggttgcgacgcggcccctggaccgaggcttgagtggagtggatggatcgaacgtacgagtggctcacaattcntacacagtagttcgagggcgaggtcactanagaccgagggacacgtcatcaaatacagctacgagtagactgangacggngagagatacgagacgacgtacggtcgttattagttactcggacgacgagtaagtagtacgtacttaccttcgtttacgttacgtagg

SEQ ID NO: 351607 - DNA, 607 bp, Homo sapiens
  misc_feature: GZ8MTXP02G1OY6.39.87.H10.1.454.CMB.2.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (369)..(369): a, c, t, g, unknown or other
  misc_feature (369)..(369): n is a, c, g, or t
  modified_base (432)..(432): a, c, t, g, unknown or other
  misc_feature (432)..(432): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctcctgtctgcatctgtagganacagacgtcaccatcacttggccggnaagtcaggactaattaaaatgtattagcctaggtatcagacaagaaaccagggaaactcgtaaggtcctagatctatgatcgccttacgtaggtttacggaaaggtcgggtacccagtacgtaagtccaggcgcgagtggattcgngggacaggtacttaccgactctacaccatcccaaccgtagcccgtagccgtactagaacgttntttcgacttaacttattacctagtactaaattaactttattccgtaactccgacttcgtaacggttccgggacgggaacggtaccgaaaggggtacgtaacgtaacgtaaccgaaaacgggtaccttggcgtactaacggactaaccctagtccgttacgtccctacgttacccg

SEQ ID NO: 351608 - DNA, 664 bp, Homo sapiens
  misc_feature: GZ8MTXP02HKJ52.39.87.H10.1.454.CMB.2.raw
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (360)..(360): a, c, t, g, unknown or other
  misc_feature (360)..(360): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccggactggaggtgaagagccgtgggcctnagtgaggtctctgcaggcttcgngaatccaccctcaccgacgtctatatcgctacgtggtcgacgacgacggtccccgtaggaccgaaggggtcttaggacggtggagtacggggataggacttacgaaacggtaacnggtcgtactacaaacttaagttgtacgactaagtaagttaaacgttcgagggtacgacggtacacctagtaccgacgacgggactacgactactacgaactacagtacctaagagttacgacgttacgacgtacggacgtacgtaggaacgtacgttacgtacggtaaccggacggtacccggggttacgttaggttttacttaacggtttcggtaggacggtaacggtagttaagtaacggtaacggtttacttaacggtttcgttaaccggtttaaggggtttaccggggttttaaacgggg

SEQ ID NO: 351609 - DNA, 654 bp, Homo sapiens
  misc_feature: GZ8MTXP02IUK9S.39.87.H10.1.454.CMB.2.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctggtaggagacagactcaccatcacgttcggccgggacaaggtcgaggactaattaaaatgtattgctggtatcagacaagaaccaaggaaactccgtaaggtctgattctagtgatcgacctcgtaggtttggaaacgttcgggaccctagtacgtaaggttcgacggcgacgtaggtgacgtcggtggggactagtactttaccactctaccaacctactaccgacccgacgtccgtacggccgtaccgttagtaaacgtttacttttacgaacttaaactttacgtttacctattaacctaaaactttaactttttaattaccctttacgtcccgtacttccgttaaacggtttccgggggaacggtaacgggtaaaccgtaaagggggtacgtaaacggactaaacgaaaaccggtacgttaggcggtactaagaactactactcctagttccttactacc

SEQ ID NO: 351610 - DNA, 612 bp, Homo sapiens
  misc_feature: GZ8MTXP02F2O67.39.87.H10.1.454.CMB.2.raw
  modified_base (365)..(365): a, c, t, g, unknown or other
  misc_feature (365)..(365): n is a, c, g, or t
tcagtcgcactagtcacgaccggtgctcgatttagcagtactgcgttgggtttgggggagtcagacccactcaggacacagcatggacatgagggtccccgctcagctcctggggctctgctgctctggctcccaggtgccagatgtgccatccagttgacccagtctccatcctcctgtctgcatctgtaggagacagagtcaccatcacttgccgggcaagtcagggcattaaaactgatttagcctggtatcagcaagaaaccagggaaaacctcctaaggtcctgatactatgatgcctccagtttaggaaagttcggggtacccatcgaaggttccagcgcagtggatcgtgggactagntttacactctcacatcaccagcctggcgcctagaaagtattttagacctaaactttagttacctgttacaaacttaattttaaacttcttacttcccggacttacgtaccgtttaccggggacggtaaacggggtacccgtaaacgggtagaaacggtaataaaccgtaaaaaccggaaacttcggggtacggtaccttaacggacctaaacccgtagttcccttaaggtttcccttacgtaacccg

SEQ ID NO: 351611 - DNA, 570 bp, Homo sapiens
  misc_feature: GZ8MTXP02IJGEI.39.87.H10.1.454.CMB.2.raw
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
  modified_base (493)..(493): a, c, t, g, unknown or other
  misc_feature (493)..(493): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactccccaggtgcagctggtgcagtccgggactgaggtgaagagccgtggggcctcagtgaaggtctcctgcaaggcttctggatccaccctcaccgacgtctactatcgactactggttgcgacgacggccccgtaggacgagggcttggagtggatggggatggatacgaaccggtacngtgtctacaactaattntcgacaacgagtagtttacggaggggtacgtacgggtacaaccgatacggacccgaagggtaccaccgtaccatacaaactacacgaccctaagacgtagaactggaacgtcgaggcagacgntacgtagacgacgacggtcgtagttacgtagtcgtacgacgagtaagagttagacgttactcttactagtttacggg

SEQ ID NO: 351612 - DNA, 554 bp, Homo sapiens
  misc_feature: GZ8MTXP02FZXQ2.39.87.H10.1.454.CMB.2.raw
  modified_base (362)..(362): a, c, t, g, unknown or other
  misc_feature (362)..(362): n is a, c, g, or t
  modified_base (512)..(512): a, c, t, g, unknown or other
  misc_feature (512)..(512): n is a, c, g, or t
  modified_base (536)..(554): a, c, t, g, unknown or other
  misc_feature (536)..(554): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagagccgtggggcctcgagtgaaggtctcctgacaaggtcttcgtggaactccaccctcaccgtacgtctatatgcctactggtgcgacgacggtcccctaggaccgaagggtcttaggagtggagtgggatggatacgaaccggtaacngtaggtactacaaacgtaaaattcgtagacaacgagttaagttacgacggggacgtacgggtacaacgacgtacggaaccgaggggaccaccgttaccaacgtacaaaactacaacgaccttaacgagtacggaacgtgacggaccgggngtacgggacgaacgggcacgaagnnnnnnnnnnnnnnnnnnn

SEQ ID NO: 351613 - DNA, 610 bp, Homo sapiens
  misc_feature: GZ8MTXP02GO8FH.39.87.H10.1.454.CMB.2.raw
  modified_base (251)..(251): a, c, t, g, unknown or other
  misc_feature (251)..(251): n is a, c, g, or t
  modified_base (277)..(277): a, c, t, g, unknown or other
  misc_feature (277)..(277): n is a, c, g, or t
  modified_base (346)..(346): a, c, t, g, unknown or other
  misc_feature (346)..(346): n is a, c, g, or t
  modified_base (473)..(473): a, c, t, g, unknown or other
  misc_feature (473)..(473): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcaggtccgggactggaggtgaagaagccgtgggcctcgagtgagtctcctgcaggctcnggaatccaccctcaccgacgtctatntgcacgtggtgcgacgacgcccctggacaagggtcttggagtggagtgggatggatcgaaaccggtacngtcgtacacgaaactaaattgtagacaacgaagttaagtttcggaaggggccgtacggggtcaaacccgtagtaccggaaccgaaggggacctaccggtaccaatacgaaactaacgacgtacctanacgtagaactagacgcgagggctagggaactagtacgacgaccgtaacgtaccggtacggttattacgttacgttagacggtaccgaggaacgtagtacgggtacttaaccgttactttacgttaacgtttaagggg

SEQ ID NO: 351614 - DNA, 630 bp, Homo sapiens
  misc_feature: GZ8MTXP02IUUKY.39.87.H10.1.454.CMB.2.raw
  modified_base (228)..(228): a, c, t, g, unknown or other
  misc_feature (228)..(228): n is a, c, g, or t
  modified_base (366)..(366): a, c, t, g, unknown or other
  misc_feature (366)..(366): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttcgacccagtctccatccctccctgtctgcatcgtgtaggagacagagtcacatcacttgccgganagtcgaggactaattaaaaatgtaattacgcgtagtatcagtacaagaaacgaggaaacctcgtaaggtctagtactactatgatcgtcctacgtagttacggaagtcggtacataccgtagtcgagcgactagtagntgtaggacagttactcactcacacactccaaccgtgcgtacggcccgtatagtaaagttacttacgtaaccttaactttattacgttattaaccctaaatttaaaacttttaacttactttactaccggttactaccgtttacgtaacgggtttaccgggacgggtaaaacgggtaaaccgtaaacggggtagaaacgttaactaaaccggtaaaagtaccgtttaagggcgtacgacgtacccgtactagtttccgtttaacg

SEQ ID NO: 351615 - DNA, 614 bp, Homo sapiens
  misc_feature: GZ8MTXP02FZX9V.39.87.H10.1.454.CMB.2.raw
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
tcagtcgcactagtcacgaccggtgctcgatttagcagtactgcgttgggtttgggggcaggagtcagacccactcaggacacagcatggacatgagggtcccccgctcagctcctggggcttctgctgctctggctcccaggtgccagatgtgccatccagttcgacccagtctccatccctccctgtctgcatctgtagganacagagtcacatcacttggccggnaagtcgagggacaattaaaaatgtaattagcctaggtatcagacaagaaaaccgaaggtaaaacctacgtaaagtcctagtactactatgatcgtaccctacgtaggtttaggaaacggtcgggtacccagtaccgtaaggtcagcgnagtgntcgaggacagtacttcactctacaccataccacacgtccgtgccggtactagaagttactttacgaaccttaaactttaattactacgtaacttaaaactttaaattttaactttccttaacgtccttacttaccgttaacggtttcgggaacgggaacgggtaaccgaagggtacgaagtaacgtaacgaaaacgtagttgaaggtacgtctacaaccgtattcgtgttacc

SEQ ID NO: 351616 - DNA, 663 bp, Homo sapiens
  misc_feature: GZ8MTXP02JMZ2N.39.87.H10.1.454.CMB.2.raw
  modified_base (202)..(202): a, c, t, g, unknown or other
  misc_feature (202)..(202): n is a, c, g, or t
  modified_base (319)..(319): a, c, t, g, unknown or other
  misc_feature (319)..(319): n is a, c, g, or t
tcagtcgcactagtcacgaccggtgctcgatttagcagtactgcgttgggtttgggggcaggagtcagacccactcagtacacagcatggacatgagggtccccgctcagctcctggggcttctgctgctctggctcccaggtgccagatgtgccatccagttgacccagtcctccatcctccctgtctgcatctgtagganacagagtcaccatcacttggccggcaagtccgagggactaaattaaaatgtaattagccttggtatcgacgacaaacggaaaccgaaggggaaaacctccgtaaaggtcctagactntaatgtatcgtccctacgtagtttaggaaagttcgggtacctagtaccgtaagttcgacgtcggacgtaggttcgacgttcggtagggaactaagttactttacacttacctacccaactactaccaaccgcgtcccgtacggtccggtcctaagggtaaactttcgtttacgaaccttaaacgtttactttaactagttaaacctaaactttaaattttacgtttaccttactaccggttcttacgttaccggtttagggaccggttaacggacgtaaagggtggaaactaacgtaaccgaaaacgtgttacgcgtacgtacgactacgtacttcgtattccg

SEQ ID NO: 351617 - DNA, 655 bp, Homo sapiens
  misc_feature: GZ8MTXP02F0HZT.39.87.H10.1.454.CMB.2.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagagcctggggcctnagtgaaggtctcctgcaaggcttcnggaatcaccctcaccgngtcatatgcatggttgcgacgacggccccctaggaccaaggggtcttaggagttggagttgggaatggaactcgaaaccggtaacagtggtctacgaactaaattncganaacgagtaacgtttcgagggcaggggtcaaccgatacgacgagggtacacgttaccatacaaacgtacaacgtacctacgagttacggaacctaggaacgaccgaggggtaccttagggaaacgtacgtaaccggtacggaacccggtaaccggaaacccggggttcccggtttaacggtttaaaccgtttacgttacgggttacgacggttaaaggaaccgtaaggttaggtaacggtttacctttacgtttacccgttaacgtttttaacggggg

SEQ ID NO: 351618 - DNA, 552 bp, Homo sapiens
  misc_feature: GZ8MTXP02GS8E3.39.87.H10.1.454.CMB.2.raw
  modified_base (350)..(350): a, c, t, g, unknown or other
  misc_feature (350)..(350): n is a, c, g, or t
  modified_base (374)..(374): a, c, t, g, unknown or other
  misc_feature (374)..(374): n is a, c, g, or t
  modified_base (410)..(410): a, c, t, g, unknown or other
  misc_feature (410)..(410): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctcttcttggtggcagcagccacaggacgcccactcccaggtgcagctggtgcaggtccgggactgaggtgaagaagccgtggggcctcagtgaaggtctccgtgcaaggcttgtggaatcaccctcaccgacgtctatatgcactggtgcgacacggccccctagggacaagggtcttagagtggagtggagtggatacgaaacggtaanagtggtactacaactaaatttagngacacgaagtaacgtttcgaagggcaggacaccganacgacgaggtacacgtcatacaaanacanacanagtagacagacgacgagtagagagtatacgtacgacgacgtacgtacgtacgttagttagtacgtacgacgagaagtagtacgtacgtacgttacttacgttacgttag

SEQ ID NO: 351619 - DNA, 606 bp, Homo sapiens
  misc_feature: GZ8MTXP02IFFR2.39.87.H10.1.454.CMB.2.raw
  modified_base (253)..(253): a, c, t, g, unknown or other
  misc_feature (253)..(253): n is a, c, g, or t
  modified_base (380)..(380): a, c, t, g, unknown or other
  misc_feature (380)..(380): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcaggtccggactgaggtgaagaagccgtgggcctgagtgaaggtctcgtgcaaggcttcgnggaatccaccctcaccgacgtctatatgctagtggtgcgacgcggcccctaggacgaaggtctaggaggtggagtgggagtaggacgtacgtaaaccggtaagtaggtggtactacgaactaaattntagactacgtagtaagttcgaaggtcgaaggtaccaacagtacggaccgtaacggacaccgtaccaactacaaacgtacgaacgtaccctaagacgttacggaacgtaggacgagacgtacgtacgaggtactacgtacgaaccggtacgtacggtaccgtaacgttagttacgtggttacgagagaagtactaggtactacctttcgttacttacgtttaacggg

SEQ ID NO: 351620 - DNA, 599 bp, Homo sapiens
  misc_feature: GZ8MTXP02ID3NN.39.87.H10.1.454.CMB.2.raw
  modified_base (394)..(394): a, c, t, g, unknown or other
  misc_feature (394)..(394): n is a, c, g, or t
  modified_base (526)..(526): a, c, t, g, unknown or other
  misc_feature (526)..(526): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctgagtgaaggtctctgcaaggcttcgtaggaactcaccctcaccgtacgtctatatcgctacgtggttgaccgacgacggcccccgtagggaaccgaaggggtcttggaggtggagtggggaatggaatacgaaaccggtacgaggtcggtcctacaactaaagttntcgacaacgtaagtaagtttcggagggacgacggggtaccacacgtacggaccgaaggggacaccgtactaactaccaaagtacacgacctaacgaagtacggaactagggacgacgaggacgtaggacgtntaccgagacgacgtacgggcgttagttatagtcgtagagagaagatacgacgttactcgttactacgtttagg

SEQ ID NO: 351621 - DNA, 633 bp, Homo sapiens
  misc_feature: GZ8MTXP02HFKYG.39.87.H10.1.454.CMB.2.raw
  modified_base (299)..(299): a, c, t, g, unknown or other
  misc_feature (299)..(299): n is a, c, g, or t
  modified_base (329)..(329): a, c, t, g, unknown or other
  misc_feature (329)..(329): n is a, c, g, or t
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
  modified_base (571)..(571): a, c, t, g, unknown or other
  misc_feature (571)..(571): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcgacggtccgggactggaggtagaagaagccgtggggcctacgagtggaacgtctcctgacaaggtcttcgaggaactccacccgtcaccgacgtctatatgcacgtggtcncgacgcgcccgtaggacgaggtctaggagnggagtggagtagtatacgtaaacggtanacggtcgtactacgaataattacgnacaagtaagtagttacgaggtacgagggtccaacgtacgtacgaacgacggactacgttacccaagtacaaactacgacgaccgtaagacgtacggacgtgaacggacgtacggagtacgaagtacgtacggtacgaaaccgcggtaaccgggtactaaggtttagttggttaggtaccggagtaaggngtaaggttaacgtacgtttacgttcccttaagttaccgtttagggtacggggttttaaaggg

SEQ ID NO: 351622 - DNA, 552 bp, Homo sapiens
  misc_feature: GZ8MTXP02FGCQR.39.87.H10.1.454.CMB.2.raw
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttctggtggcagcagccacaggagcccactccccaggtgcagctggtgcagtccggactgaggtgaagaagcctgggcctcagtgaaggtcnctgcaggctcnggaatcacctcaccgacgtcatatgcactggttgcgacaggccccctaggacaaggggcttaggaggtggatggggatgggatcgaaacggtaacccagtggtctacgaacaaaattatgaccacaagtaagtttcaggggcaggggtccaaccagtagaccgagggaacacgtccaatacgaatacagaccctacgataggaactgaacgcgaggtacgagaacgatacgagacgaacgaccggtacgttagtaacttagttgtcgtacgaggagaagtggaattactcttacgtacgtagttcgggg

SEQ ID NO: 351623 - DNA, 683 bp, Homo sapiens
  misc_feature: GZ8MTXP02GMU4S.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaacgccgtggggcctcagtgaaggtctcctgccaaggtcttcgtggaactccacccctcacccgtacgtctatatcgactacgtggttcgccgaccgacgggtcccccgtggaaccgtaaggggtcttagggaacggttggacgtaggggtattcgggaactacggaaaaccgggttacgaacggttcgggtccctacgtaaactaaagtttacgtacgacctaaacggtaaggtaaccggtttacggaagggggctaacgggggtccaaccgtagtacggaccgaaacggggacccaaccggttaccacttaacgaaacgtaaccgacgtaccctaacgtataacgggacttaggacgtacgaggctaggagtagtcgaggtaccgacgaccggtcgtacgttagttacgttggacgtacgagtacgagtggtaacgttcttacttagtacgtacggtttacgggttaacggg

SEQ ID NO: 351624 - DNA, 626 bp, Homo sapiens
  misc_feature: GZ8MTXP02HFTG8.39.87.H10.1.454.CMB.2.raw
  modified_base (251)..(251): a, c, t, g, unknown or other
  misc_feature (251)..(251): n is a, c, g, or t
  modified_base (593)..(593): a, c, t, g, unknown or other
  misc_feature (593)..(593): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcagtgaaggtctctgcagcttgnggatcaccctcaccgagtctatatgctactggtgacgacgacggcccctaggaaccgaaggggtccttggacggttggagttgggatggaactcgaaaccggtacaggttcgtactacaataaacttgtacgactaaacgtagtaacgtttcgaggggtaccgaggggttaccaaccgtagtccggaacccgaggggaacctaccggtaccaacgtaccaaaacgtacgacgtaccttaaacgacggttaacgggaaacctgggaacgaccgtaaggtcgtacggagtacgttacgagaaccggacgtaccggtcgttagtagttacgttggacgagtaagngtaagtggtacttactcttacgtacgtttaggg

SEQ ID NO: 351625 - DNA, 594 bp, Homo sapiens
  misc_feature: GZ8MTXP02GEG2V.39.87.H10.1.454.CMB.2.raw
  modified_base (441)..(441): a, c, t, g, unknown or other
  misc_feature (441)..(441): n is a, c, g, or t
  modified_base (473)..(473): a, c, t, g, unknown or other
  misc_feature (473)..(473): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggagatcctcttcttggtggcagcagccacaggagcccactcccaggtgcagctggtgcagtccgggatgaggtgaagagccgtgggcctgagtgaaggtctcctgacaaggcttacgtggaaactccaccctcacccgtacgtactatatgcacgtggttgcgacgacgcccctaggaccgaagggcttaggagtggagtgggatggtatacgaaacggtacaggtagtctacaaataaattacgtagaccataaagtaaagtttccgagggacacgggtcaacctagacgaccgaaggactactaccatanaaacgtacacgtacctaacagtagtaaaccgngacgacgagacgaggaaatacgtacgacgaacgacgtacgtacgttaagttagttagtagacggacgaagacgtagtaacgtaactacttacttacgtaacggttacggttacggttaagg

SEQ ID NO: 351626 - DNA, 688 bp, Homo sapiens
  misc_feature: GZ8MTXP02HL9O9.39.87.H10.1.454.CMB.2.raw
  modified_base (254)..(254): a, c, t, g, unknown or other
  misc_feature (254)..(254): n is a, c, g, or t
  modified_base (533)..(533): a, c, t, g, unknown or other
  misc_feature (533)..(533): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagccgtggggcctcgagtgaaggtctcctgcaaggcttcgnggaactccacccctcacccgacgtctatatcgacacgtgggttcgacgtaccgaccggccccctagggacaacgggtcttacggagggttggaagttgggaagtggagtacgaaaccggttacgaggtggtacctacgaacgtaaatttagcgaactaacgaagttaacgtttacgacggggtacgacgggtaccaacgtaacgtcggaaaccggaacggggacctaacccggtacccaaacttaaccgaaacgttaaaccgaacgtaccccgttaaanacggttaacgaaccgtagggacgaccggaggtacgaggtacgacgtacgtacggaacgtaaccggacgggtacccgttagttacggtttagtacggtacggagttaacgaaggtattacggtacttaccgtttacttacgtttacgtttaacggg

SEQ ID NO: 351627 - DNA, 607 bp, Homo sapiens
  misc_feature: GZ8MTXP02HYIXE.39.87.H10.1.454.CMB.2.raw
  modified_base (253)..(253): a, c, t, g, unknown or other
  misc_feature (253)..(253): n is a, c, g, or t
  modified_base (499)..(499): a, c, t, g, unknown or other
  misc_feature (499)..(499): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactccccaggtgcagctggtgcaggtccgggactgaggtgaagagccgtggggcctcagtgaaggtctctgcaggcttcgnggaatccaccctcaccgacgtctatatcgctacgtggttcgaccgacgtacgggcccctaggaaccgaagggtcttaggaggtggagtaggggatagggatccgaaaaccggtacgtaggtcggtacctacaaaccttaaattcgtcgaactaacgtagtaagtttcgagggtacgaagggtaccaacgagtacgaccgaaagggaccctaccggtaccaataccgaaactacgaagtccctaaanagttaacggactagacgcgagcgtagacgactacgacgaacgacgacggtatacgttataagttgacgagaagaagtagtacgacgttactacgttactaaacgttgg

SEQ ID NO: 351628 - DNA, 565 bp, Homo sapiens
  misc_feature: GZ8MTXP02H21QX.39.87.H10.1.454.CMB.2.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (461)..(461): a, c, t, g, unknown or other
  misc_feature (461)..(461): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
tcagtcgcactagtcacgaccggtgctcgatttagcagtactgcgttgggtttgggggagcatcacccagcaaccacatctgtcctctagagaatccccctgagagcctccgttcctcaccatggactggacctggaggatcctcttcttggtggcagcagccacaggacgcccactcccaggtgcagctggtgcaggtccggatgaggtagaaaggaagccgtgggcctagagtgaaggtctcgtgcaaggtcttcgaggaatccaccctcgtaaccgacgtctatatgacncgtggtncgacgcggccctaggaacaagggnttggagtggangggatggaatcgaaaacgggtaacaggtgtactacaaacgtaaattntgaacagaagttaacgttcgaagggctaaggcaacgtancgaaaccgnggacacgtaccaanacanaacgacgactaanagtagaangagacgaggnagagatacgacgaacgcgacgtcgtaattagtacgtcgacgagaaagaagtacgtaagtacgtaccttcgttaacgtaaggttagg

SEQ ID NO: 351629 - DNA, 631 bp, Homo sapiens
  misc_feature: GZ8MTXP02JUGKC.39.87.H10.1.454.CMB.2.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (577)..(577): a, c, t, g, unknown or other
  misc_feature (577)..(577): n is a, c, g, or t
tcagtcgcactagtcacgaccggtgctcgatttagcagtactgcgttggggtttgggggagtcagacccactcaggacacagcatggacatgagggtccccgctcagctcctggggcttctgctgctctggctcccaggtgccagatgtgccatccagttcgacccagtcctccatccctccctgtctgcatctgtagganacagagtcaccatcacgttcggccggganaagtcgagggactaaattaaaagtgtatttacgccttaggtatcaagacaaacgaaaaccgaacgggtaaaacctccgtaaacggtcctagtatctagtgactcgtacctcgtaaggtttacgggaacggttcgggtaccagtacgtaaggtccgaggcgacgagtcggatcgtggggaactagttacttacgactcgtaccacctatacccgacctacgccgtcggccgtactaaggtaacgttatttacgacttaaacgttattactaagttaaccttaaatttaatttacttacttacgtcctattacgtacggttacggacgggtaacgacgtaagggtcganaacgtacgaaacgtacgtggtacgctaacgactacgtatcgtcttacctctacc

SEQ ID NO: 351630 - DNA, 596 bp, Homo sapiens
  misc_feature: GZ8MTXP02H8NIE.39.87.H10.1.454.CMB.2.raw
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagaacgccgtggggcctcagtgaaggtctctgcaagcttngatcacctcacgacgtctatatgctacgtggttcgcgacncggcccctggaacgagggtcttggagtggagtgggagtggactcgaaaccggtaanaggttcgtactacaacttaaattcgngacaacgagtaacgtttcggaagggtccgagggtacaacccgtagtacgaccgacgggacaccgtaccatacaaatcaacgccctaagacgtagacctaggacgagcggtacgagtaagtcgtaccgtaggaccgtaacgaccgggtccgttagttaaagttcgttgtacggagtaacggaagtagtacgtacgttaccttacgtttacgtacgtttaggg

SEQ ID NO: 351631 - DNA, 609 bp, Homo sapiens
  misc_feature: GZ8MTXP02GAUVW.39.87.H10.1.454.CMB.2.raw
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (390)..(390): a, c, t, g, unknown or other
  misc_feature (390)..(390): n is a, c, g, or t
  modified_base (463)..(463): a, c, t, g, unknown or other
  misc_feature (463)..(463): n is a, c, g, or t
  modified_base (507)..(507): a, c, t, g, unknown or other
  misc_feature (507)..(507): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcaggtccggatgaggtgaagagccgtgggcctcgagtgaggtctccgtgacaggtcttgaggaactccaccctcaccgactctatntcgcagtggtcgcgacgacggtccccgnggaacgaagggtcttggaggtgggtagtagggtactagggtactaacggtaaacggtaacgagttcggtactacaaactaaagttntcgactaaacgtagttaacgttacgagggcgtacgggtaccacgagtacgaacgacgggacacgacatacaanacacgtacacgtaggacgactaggacgtacgagcgtagacgtanacgtacgacgaccggacggttacgttagttacgttaggttggacgacgaaggaagtggtaacgtacgttaccttacgtacgtttacgtaaggggtttagggg

SEQ ID NO: 351632 - DNA, 603 bp, Homo sapiens
  misc_feature: GZ8MTXP02JG3ZV.39.87.H10.1.454.CMB.2.raw
  modified_base (464)..(464): a, c, t, g, unknown or other
  misc_feature (464)..(464): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgagtccgggactggaggtgaagacgccgtggggcctgagtgaggtctctgcaaggcttcgaggaactcacccctcaccgtacgtctatatcgcacgtggtgcacgacggccccgtaggacgagggtcttaggagtggatgggatggatacgaacggtacagtcgtactacaacgtaaattgcgacacgtaagtaacgtttacgagggccgaacgggtcaaccgtagacgacgtaagggactacgaccaagtacaaactacacgtccctaaanacgtaggaacctggacgacgagcgtagagacgtcgaggaccgacggtaccggtcgttagttaacttcggtaggtaccgtaggaagtaacggtaagttacggtacggttaccttacgtttacgtaacggttttaacgggg

SEQ ID NO: 351633 - DNA, 712 bp, Homo sapiens
  misc_feature: GZ8MTXP02GKF4C.39.87.H10.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttcgacccagtcctccatccctccctgtctgcatctgagganacagatcacatcacgttggccggganaagtcgaagggactaaattaaaatgtatttagcctaggtatcagacaagaaaaccgaagggtaaaacctccgtaaaggtcctagacttcgtatgactcgcccttacgtaaggtttagggaaaacggttcggggtacctagtacgtaaaggttccgaacgggccgacgtaggtacggtacgttcggtagggggaactaaggttactttaccaccttacactaacccactaccaaccgtacgcctacggccgtaccgtaggtaaacgtttagtttacgaaccttaaacttttaattaacctattaaacttaaaactttaattttaacttacttacctcccgttacttacgttacggttcggaacggggtacgaacggtaagggtacggtaaataactaaaccggtaaaacgtccggtttaggacggtaccgttaacgaacccttaaccggttagttcccgtttcgttaccctttaccgtttaaccccg

SEQ ID NO: 351634 - DNA, 564 bp, Homo sapiens
  misc_feature: GZ8MTXP02ICC4W.39.87.H10.1.454.CMB.2.raw
  modified_base (350)..(350): a, c, t, g, unknown or other
  misc_feature (350)..(350): n is a, c, g, or t
  modified_base (473)..(473): a, c, t, g, unknown or other
  misc_feature (473)..(473): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaatccgtggggctcagtgaggtctctgcaagcttcgtggaatccgaccctcaccgagtctatatgcacgtggtgcgacacggcccctggacgaaggcttaggagtggagtgggatggatcgaaggtaaccaggtcgtcanaacgtaaattctgcaacagtaagttcgagggcacgggtcaaccgagtacgacccgagggacctacgtcaatacaacgtacacgacctaacgagttaggaaactggacgacgaaggctaagganacgtgtacggacacgtacggacgttagtaattacggttgtacgacggaagagaagtcgtagtaaccttgtttaccgtattacggttagggg

SEQ ID NO: 351635 - DNA, 552 bp, Homo sapiens
  misc_feature: GZ8MTXP02IWAUZ.39.87.H10.1.454.CMB.2.raw
  modified_base (198)..(198): a, c, t, g, unknown or other
  misc_feature (198)..(198): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (373)..(374): a, c, t, g, unknown or other
  misc_feature (373)..(374): n is a, c, g, or t
  modified_base (378)..(378): a, c, t, g, unknown or other
  misc_feature (378)..(378): n is a, c, g, or t
  modified_base (536)..(536): a, c, t, g, unknown or other
  misc_feature (536)..(536): n is a, c, g, or t
tcagtcgcactagtcacgaccggtgctcgatttagcagtactgcgttgggtttgggggagtcagacccactcaggacacagcatggacatgagggtcccccgctcagctcctggggcttctgctgctctgtctcccaggtgccagatgtgccatccagttgacccagtctccatccctccctgtctgcatctgtaganacagagtcaccatcacttggccgggacaagtcgaggactaaattaaaatgtattagctgatcagcaagaaacgaggaaactcctaagtctagatcatgatgcctcgtagttaggaagtcgggtaccatcgaagtcagcgnagtgatgngganagtacttcactctcacatcaccnnccgngcgtcagtaagtatttcgacttaatttattacgtataactaaactaattttaattccttaactccgtacttactaccggtttacggacggtaacggaaccgtaagggtacgtagaaacgtaacaaacggtaagtcgtcggactaacgacctaaccttntcctacgttcttactc

SEQ ID NO: 351636 - DNA, 608 bp, Homo sapiens
  misc_feature: GZ8MTXP02I13IL.39.87.H10.1.454.CMB.2.raw
  modified_base (250)..(250): a, c, t, g, unknown or other
  misc_feature (250)..(250): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcagtgagtctctgcagcttcgnggatcaccctcaccgtacgtctatatgctacgtggtgccgacgacggcccctaggaccgaagggtcttggagtcggagtgggatggaatcgaaaccggtaactaggtcgtctacaactaaattgtagacaacgtagtaacgtttacgacggggacgtaggggtaccaaccgagtcgaaaccgaggggaacaccgtaccagtacaaacgtacacggtacctaacgaagttacggaaacctgggaaacgcgaacggtcgtaggtacgagtacgtacggacgacggtaccggtccgtaagttataacgttgacgacggaagtaagtatacggtacgtacttcgttactaacgtttacgggg

SEQ ID NO: 351637 - DNA, 609 bp, Homo sapiens
  misc_feature: GZ8MTXP02GROY9.39.87.H10.1.454.CMB.2.raw
  modified_base (247)..(247): a, c, t, g, unknown or other
  misc_feature (247)..(247): n is a, c, g, or t
  modified_base (281)..(281): a, c, t, g, unknown or other
  misc_feature (281)..(281): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagagccgtggggcctcagtgagtctcctgcagctcngaatcaccctcacgacgtctatatgcactggttncgacgacggcccctggacgaaggtctggagtggagtggatggatacgaaaccggtacngtgtctacaataattangacaacgtaagtacgtttcgagggtcaacgggtcaaacccgtataacgggaccgagggtaaccaccgtacaactaactaaactaccgactaccctaaagacgtacgaacgtacggaagaccgaggtcctaggtaacgacgttaccgaagtaaccggaaccggtaaccggtccgtttaaagttacgttacgttaggtacgaccgtaggtaaggtacgttaggtacgttaacttccgtttagtaacgtttagggg

SEQ ID NO: 351638 - DNA, 518 bp, Homo sapiens
  misc_feature: GZ8MTXP02GKZ8F.39.87.H10.1.454.CMB.2.raw
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
tcagtcgcactagtcacgaccggtgctcgatttagcagtactgcgttgggtttgggggagcatcacccagcaaccacatctgtcctctagagaatcccctgagagctcccgttcctcaccatggactggacctggaggatcctcttcttggtggcagcagccacaggagcccactcccaggtgcagctggtgcaggtccgggactgaggtgaagaagccgtggggcctcgagtgaaggtctcctgcaaggcttctggaatcaccctcaccgacgtctatatgcacgtggttgcgacacggcccctaggacaagggcttggagtggagtgggatggatacaaccggtacngtgtactnaactaattntgacacgagtagttcgagggcagggtcaccatacggacaaggacacgtcagtacaatcagctanatagactagancgagctgantacngacgacgacggctagtattgtgtcgtacgagaagtactagacgttactcgttactacgtttagg

SEQ ID NO: 351639 - DNA, 810 bp, Homo sapiens
  misc_feature: GZ8MTXP02HUX2Z.39.87.H10.1.454.CMB.2.raw
  modified_base (367)..(367): a, c, t, g, unknown or other
  misc_feature (367)..(367): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtggggcctcagtgaaggtctcctgcaaggcttctggaatccaccctcacccgacgtctatatgcactggttgcgacacggcccctggacaaggtctgaggtggagtggatggactcgaaacggtaccaggtggtactactaacgtaaaatttncgtacgaacgtaaggtaaacggtttttacccgaagggggtacctaaacggggggttacccaaacccgtaagttaccgggaaaaccccgtaaacggggggtaaacccaaacccggggtttacccccgaaaattttaaacccgaaactttaaaacccgaaacgggtacccccttaaaccgtaaagttttaacgggggaaaacccgttgggaaaaccggggtaccccgtaaaagggggaccctttaaagggggaacccgggtaaattacccggtttcggtaaaaacccggggacccgtaaccgggggtaccccggttttacggggttaaaatttttaaccgtttgggttaccgggaccggtaacgggttaaagtaaccgttagggtaacgtttaaccggttacccttttacgttaaaacccgtttacggggtttttaaacgggggg

SEQ ID NO: 351640 - DNA, 531 bp, Homo sapiens
  misc_feature: GZ8MTXP02FW4SU.39.87.H10.1.454.CMB.2.raw
  modified_base (454)..(454): a, c, t, g, unknown or other
  misc_feature (454)..(454): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggagatcctcttcttggtggcagcagccacaggagcccactcccaggtgcagctggtgcagtccgggactgaggtgaagagcctggggcctcagtgaggtctcctgcaaggcttctggaatcaccctcaccgacgtctatatgcactggttgcgacaggcccctggacaagggcttgagtggatggggatggatacgaacggtaacagttggtctacaacaaatttatgcacagtaagtttcgaggggcaggggtcaccgatcgaccgagggaccacgtccgatcaaatacagacctacagtcggaaactgagcgaggctagacgntctgacgacgcggtacgtagttattagtgtgcgtagagagtaagagttactcttacgtactagtgggtttaacgggg

SEQ ID NO: 351641 - DNA, 621 bp, Homo sapiens
  misc_feature: GZ8MTXP02J0APM.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctctgcaaggcttctggaatcaccctcaccgacgtctatatgcactggtgcgacacggcccctggacaggcttgagtggatgggatggatacgaaccggtacagtgtctacaactaaattgagtacacgagtaacgtttcgacgggtacgtacggggtcaaccgacgtacggaacccgaagggggaccaccggtccaactacaaactacacgacctaaccgagtaggaaccgtggaagccgaagggaccgtaggaagtacgtaccgtacgaaccggaccgaaccggggtaccgttaggttaaactttaggtttaccggaggaccgggtaagaacggtaagttaccggtaaaggttccctttacgtttacggtaactttaacgggg

SEQ ID NO: 351642 - DNA, 605 bp, Homo sapiens
  misc_feature: GZ8MTXP02JEZ60.39.87.H10.1.454.CMB.2.raw
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtcctccatcctccctgtctgcatctgtaggagacagacgtcaccatcacgttcggccgggacaagtcagggactaattaaaatgtatttacgccttaggtatacagacaagaaaccgaagggaaactccgtaagtcctagatctatgactcgaccttacgtaggtttaggaacggtcggggtacccagtacgtaaggttccgacggtcggcgtaggtgtagttcgtgggactagtacttcactctacacctatccaaccgcgtcctgccggtactaggaacttcgtttcgacttaactttagttactagtaactaaacttaattttacttactttacgcccgtattaccgtacgttcggggacgtaacggtacgtaagggtgaaccgtataccgaaacggtactcggcgtacaacgcaccgtatcctgttactctacg

SEQ ID NO: 351643 - DNA, 723 bp, Homo sapiens
  misc_feature: GZ8MTXP02JRPIY.39.87.H10.1.454.CMB.2.raw
  modified_base (250)..(250): a, c, t, g, unknown or other
  misc_feature (250)..(250): n is a, c, g, or t
  modified_base (276)..(276): a, c, t, g, unknown or other
  misc_feature (276)..(276): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcagtgaaggtctcctgcaggctntggaactccacctcaccgagtctatngcacgtggtcgcgacgccggccccgtaggaacgaaggggtcttaggaggtggagtggggtaattagggacgtacggaaaccggtaacgtggttacggtaccgtacaaacttaaacgttgtacggaacgaaaccgtaagggttaacgtttacggaacggggtacgtacggggtaacccaaccgtacgttacggaacccggaaggaacccgacccgttaacccgtaataaccaaaacgttaaccgaaacggttaccctaaacgaacggttaacggaaccgtacgggaaccgacggtacggtacgacgtaacggtagttacccgtaaggtaaccggaccgggtaaccgggtaccgttaaggttaagttacgggttcgaaccggaggtaaacgaaggtaagttacggggtaactttaaccgtttcgttaaaccgttaccggtttaacgggg

SEQ ID NO: 351644 - DNA, 613 bp, Homo sapiens
  misc_feature: GZ8MTXP02G7BHF.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgacaaggcttcgtggaatccaccctcaccgacgtactatatcgacacgttggtcgacgtacgacggtccccctaggacgaagggtcttaggaggtggagtgggagtacggataccgtaaacggtaaccgtaggttcggtactacgaactaaaagttctgacctaaacgtaagtaacgtttcgaacggggtcgaacggggacccaacgagtacgaaccggacgggacctaccggtaccaacgtacaaacgtaccgacgtacctacgaagtacggaacgtgacgacgagcgagagctgtacgacgacgacggtcgtagttacgttagtcgcgacgagagaacgtgtactacttctacgttacgtaggttacgggg

SEQ ID NO: 351645 - DNA, 573 bp, Homo sapiens
  misc_feature: GZ8MTXP02FI78O.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctacctgcaaggcttctggaatcaccctcaccgacgtctatatgctactggttgcacgacggccccctggacaaggcttggagtggagtgggatggatacgaaccggtaacagtggtctacaacgaaattgtcgactacgtaagtaacgtttcgaaggggtcgtaacggggtcctaaccgagtcgaacgagggtaccacgtaccaatcgaaatacagtacctacagtagaactggagacgagcgtagagactacgagacggacgacggtccgttaggtattagtcggtacgacggaagaaggtagtagtaacgtactttacgtacgttacttaagggg

SEQ ID NO: 351646 - DNA, 543 bp, Homo sapiens
  misc_feature: GZ8MTXP02JG99U.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagcccgggactgaggtgaagagcctggggcctcagtgaaggtctcctgcaaggcttcgtggaatcaccctcaccgacgtctatatgcactggttgcgacacggcccctggacaagggcttggagtggatgggatggatcgaacggtacagtgtctacaacgaattgtgacaacgagtaagtttacgagggacacggggtacacccgtagtacgaaccgaaggggactaccgtaccaagtacaaatacacgacctaacagtacggaactgagcgaggctagagatacgagacgacgacggcgtagtattacgttgacgacgagaagtatacgacgtatcttactagtttagg

SEQ ID NO: 351647 - DNA, 538 bp, Homo sapiens
  misc_feature: GZ8MTXP02GWLF1.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtgtcagcagccacaggagcccactcccaggtgcagctggtgcagtccgggactgaggtgaagaagccgtggggcctcagtgaaggtctcctgcaaggcttctggaatcaccctcaccgacgtctatatgcactggttgccgacacggcccctggacaagggcttgagtggagtgggatggatcgaacggtacagtggtactacaactaaattatgcacgagtaagtttcgagggcagggtccacgatcgacgagggacacgtacatacaatacacgacctacagtacgaactgacgcgagcgtagagtatcgtgacgacgtacggccgttagtacttagtgtcgacgagagtagtaagtacgtacttcttactactaggttcggtttaaggg

SEQ ID NO: 351648 - DNA, 574 bp, Homo sapiens
  misc_feature: GZ8MTXP02JPTCC.39.87.H10.1.454.CMB.2.raw
  modified_base (225)..(225): a, c, t, g, unknown or other
  misc_feature (225)..(225): n is a, c, g, or t
  modified_base (290)..(290): a, c, t, g, unknown or other
  misc_feature (290)..(290): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (419)..(419): a, c, t, g, unknown or other
  misc_feature (419)..(419): n is a, c, g, or t
tcagtcgcactagtcacgaccggtgctcgatttagcagtactgcgttgggtttggggcaggagtcagacccactcaggacacagcatggacatgagggtccccgctcagctcctggggcttctgctgctctggctcccaggtgccagatgtgccatccagttgacccagtctccatcctccctgtcctgcatctgtaggagacagagtcaccatcacttgccggnaagtcagggcattaaaatgattagcctggtatcagcagaaccaggaaactctaagcctgatctangatgcctctagttggaaagtgggtaccatccaagtcagcgcagtggntcgngggacagtattcacttcgacacctatcacccagccctagcggccctagtaaactagttttgactaaacttattacgtntaactaactaaatttaacttccttaagttcccgtcttacgtacgttttcggaacgggtacggtaaccggaaaggtagggaaccgtaagtaccgaaaaaccgtacggttacggtaaggtccgttaggacccaaacgtcgtttaccttacgtttccc

SEQ ID NO: 351649 - DNA, 632 bp, Homo sapiens
  misc_feature: GZ8MTXP02HX5F0.39.87.H10.1.454.CMB.2.raw
  modified_base (251)..(251): a, c, t, g, unknown or other
  misc_feature (251)..(251): n is a, c, g, or t
  modified_base (384)..(384): a, c, t, g, unknown or other
  misc_feature (384)..(384): n is a, c, g, or t
  modified_base (456)..(456): a, c, t, g, unknown or other
  misc_feature (456)..(456): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactccccaggtgcagctggtgcaggtccgggactggaggtgaagaagccgtgggcctcagtgaggtctctgcagcttcnggatcaccctcgaccgacgtctatatcgctacgtggttcgccgactacggcccctaggaaccgaagggtccttaggaggtcggtagtcgggagtggatacgaaccggtaacaggtcgtactacaactaagttngacacgagtaagtttcgagggtcgaggtacacgtagtacgacgacgggacacgacatacaatacagtcctanacgtaggactaggacgacgtacgacgtacgacgtaacgtcgaaacggtacccggaaccgtacccgggtccgttaacggtttacgtttaaggttccggttacgggacggtaaacggtaacggtaagttacggtaccggtttaaaccgttcctttaaccgtttaacgtttaacggggg

SEQ ID NO: 351650 - DNA, 564 bp, Homo sapiens
  misc_feature: GZ8MTXP02HJQJC.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtccgggactgaggtgaagaagccgtggggcctcgagtgaaggtctccgtgcaaggtcttcgtggaatccaccctcaccgacgtctatatgcactggttgcgacgacggcccctggaacagggtcttagagtggatgggatggatacgaacggtaacagtggtactacaactaaattatcgacaacgtagtaaagtttcgaagggtcgagggtacaccgagtacgaccgaaggacaccgtaccagtacaatacgagacctacgagtagactggaagcgaggctagagtatacgtagaacgacgacggtcgtagttagttacgttgcgtacgagtaagatacggtacgtacttacttacgttacgttaggg

SEQ ID NO: 351651 - DNA, 601 bp, Homo sapiens
  misc_feature: GZ8MTXP02I3IM9.39.87.H10.1.454.CMB.2.raw
  modified_base (297)..(297): a, c, t, g, unknown or other
  misc_feature (297)..(297): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggactggaggatcctcttcttggtggcagcagccacaggacgcccactcccaggtgcagctggtgcgacggtccgggactggaggtagaagaagccgtggggcctcgaggtgaaggtctccgtgcgaaggtcttacgaggaactccaaccctcgaaccgtacgtctaagtntcgactacgtggtcgaccgacgcggccccgtaggaacgaggtctaggagtggagtgggatggatcgaaccggtacagtcgtctanaactaaattgngacagtagtagttcgagggtcaggtcacgagtcgaacgaggactaccgtacaagtaccaaagtacacgtacctaacgaggtacggtaacnggaacncggagtacgagaatcgtacggtacgtaaccgaccgcggttacgtaggttacttagttcggacgagaagtaacgacgtagttaaacgtccttcgttaacgttacggtttaggg

SEQ ID NO: 351652 - DNA, 678 bp, Homo sapiens
  misc_feature: GZ8MTXP02HO5Q8.39.87.H10.1.454.CMB.2.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (466)..(466): a, c, t, g, unknown or other
  misc_feature (466)..(466): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttcgacccagtcctccatcctccctgtctgctatctagtagganacagagtccaccatctacgtggccggganaagtcgagggtactaaagttaaaactgtactttacgccgtggtactcaagacaaacggaaaccgtaagggaaaaccttaccgtaaacggtcctagtaattctatgtatcgtcctacgtaggtttaggaacggttcgggtacctagtacggtaacggttccgaggcggactagggttggacgttacggtggggaacttagtacttaccgtactccacctaccactaccgaaacccncgtaccgtcggtacccggtacttaaggtaacgttacgtttacgtacttaaaacttttcgttaaaccttgttaaacctttaaattaacttttaacttacgttacctcgtactcggttacggttacggggacggtaacggtacggaggttacgagtaaactacgaaacgtacgtgtacgtctccgtataaccgtcttacgtcttacttactccc

SEQ ID NO: 351653 - DNA, 551 bp, Homo sapiens
  misc_feature: GZ8MTXP02IKXXU.39.87.H10.1.454.CMB.2.raw
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (421)..(421): a, c, t, g, unknown or other
  misc_feature (421)..(421): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagagcctggggcctcgagtgaaggtctcctgcaggcttctggaatccaccctcaccgacgtctatatgcacgtggtgcgacgacggcccctggaccaagggtcttggagtggagtgggatggatcgaacggtangtgtctacaactaatangcacagtaagttcagggcagggtcacatgacgaggacacgtacatacaatacagaccgtaanacgaagtacgtagagacgagacgtagagttttacgacgtacgaacgacgaccggtacgttagttagttacgttagtgacggagagtagtaagtacgtaacttcttactacgttacgtaggtttaacgggg

SEQ ID NO: 351654 - DNA, 539 bp, Homo sapiens
  misc_feature: GZ8MTXP02H6B8C.39.87.H10.1.454.CMB.2.raw
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
  modified_base (407)..(407): a, c, t, g, unknown or other
  misc_feature (407)..(407): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagagccgtgggcctgagtgaagtcnctgcaggctngatcaccncacgcgtctanatgcacgtggtgacgacgacggccctaggtacgaaggtcgttgagtggagtgggataggatacgaaccgtanacgtaggtactacaataaatttngtacaacgtaagtaacggtttcaaagggtccgaggtacaactacngaacccgagacacgtcaactacaaanananactanagaganagagacgagagagagatacgacgacgacgacgtacgtacgtagttagtacgtcgtaggagaagtagtacgtactactacttacgtacgtag

SEQ ID NO: 351655 - DNA, 609 bp, Homo sapiens
  misc_feature: GZ8MTXP02IGP9J.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtagaagagccgtggggcctcgagtgagtctctgcgagcttcgaggaactccaccctcaccgtacgtctagtatgcgtagtggtcgcgacgccggccccgtggacgaagggtctaggaggtgggagtgggagtaggatacgtaacggtaccaggtcgtactacgaactaaattgtcgacaacgtaaggtaacgtttcggagggtacgtaacgggtaccaaccgtagtacggaacggaacgggtaccaccgtccgaatacgaaacgtacaccgtacctaagaacgtaggaccgtagacgacgaggtcagagactcgacggacgaccggtacggtacgttagttaagttagttcgagacgtagagtaagtacgtacgttacttcgtacttacgtaggtttacgggg

SEQ ID NO: 351656 - DNA, 647 bp, Homo sapiens
  misc_feature: GZ8MTXP02GDESA.39.87.H10.1.454.CMB.2.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtgcagcagccacaggagccccactcccaggtgcagctggtncagtccgggactgaggtgaagacgccgtgggcctnagtgaacggtctcgtgcaaggtcttcgtggaactccacccctcaccgacgtctaatatgcacgtggtgcgacacggcccctaggaccgaagggtctaggaggtggagtggatggaactcgaaaccggtacaggtgtactacgaactaaattgtacgactaagaagttaaacgttcggaacggggtacgaacggggtaccaacccgtaagtacggaaccggaacggggaaccctaacccggtacccaactacctaaaacgtacaacgtaccccgttaaacaggttacgggtaaacagggacgtaccggaaggtacgacggtaaacgactaccgtacggaacccgtacggacggtcccgtaagttactaacgttcgtagaccgaagaacgtatacggacttacgtactacgtacgtttacggg

SEQ ID NO: 351657 - DNA, 637 bp, Homo sapiens
  misc_feature: GZ8MTXP02IYV71.39.87.H10.1.454.CMB.2.raw
  modified_base (183)..(183): a, c, t, g, unknown or other
  misc_feature (183)..(183): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtncagctggtgcagtccggactgaggtgaagagcctggggctcagtgaaggtctcctgcaggcttctggaatcaccctcaccgacgtctatatcgcactggttgcgacacggccccctaggaccaaggggtcttggacgtggagtggggatggactcgaaccggtaacaggttcggtcttacaaccgtaaatttgtagaccaacgtaagtaacgttttacgaagggggaccgtaacgggggttacaacccgtagtacggaacccgtaacgggggaaccacccggttaccaacgttacaaactaccgaacggacccctacaacgttacggaaacctggaacgccgaaggccttaggaacgtatacgtacgaaccgacgacgggtccgtttaggtactttagtggtacgacgaagaagtagtacgtacgttaccttacgtttaccgtaacgtttaggg

SEQ ID NO: 351658 - DNA, 605 bp, Homo sapiens
  misc_feature: GZ8MTXP02I5WIZ.39.87.H10.1.454.CMB.2.raw
tcagtcgcactagtcacgaccggtgctcgatttagcagtactgcgttgggtttggggcatcacccagcaaccacatctgtcctctagagaatcccctgagagctccgttcctcaccatggactggacctggaggatcctcttcttggtggcagcagccacaggacgcccactcccaggtgcagctggtgcaggtccggactgaggtgaagagccgtgggcctgagtgaaggtctcctgcaaggtcttcaggaactccgaccctcacccgacgtctactatgacctagtggtcgcgacaccggtcccctggaaccgaagggcttaggaggtggatgggactgggactacgaacggtacaggtcgtactacaataaattactgacaacgtagttaacgtttcgaagggacgtacggggtaccacgtaactcgaaccgagggtaaccacgtaccgattacgaaatacgacgtacctaacgtagtcgaaacgtcgaatacggacgtgtagacggaactcgtacgacgtaccgacggacgtttagtaacttagtcgtgaccggtagacgtaagtggtaacttcgttacttactaacgttaggtttacggg

SEQ ID NO: 351659 - DNA, 646 bp, Homo sapiens
  misc_feature: GZ8MTXP02HA1W8.39.87.H10.1.454.CMB.2.raw
  modified_base (601)..(601): a, c, t, g, unknown or other
  misc_feature (601)..(601): n is a, c, g, or t
tcagtcgcactagtcacgaccggtgctcgatttagcagtactgcgttgggtttggggatcacccagcaaccacatctgtcctctagagaatcccctgagagctccgttcctcaccatagactggacctggaggatcctcttcttggtggcagcagccacaggacgcccactcccaggtgcagctggtgcaggtccgggactgggaggtagaagacgccggtcgggcctagagtagacggtcctcgtgacgaggtctgagactccaccctacaccgactactatagtcgactagtcggtcgaccgaacgcccggcccgtaggacggacggtcgtaggaggtggaggtagggtagtaggtaactaaccggaaacggtacgacggttcgtactaacgaaacttaattcgacgacaacgtaaaggttaacgttcggaacggtacggacggtaccaacgtacgaccggaacgaacgggactacccgtactacgtaacaacgtaacgacgtactaacgagtaacggactgacgtaggacgacgtagatcgtacgacggaaccgtacgtacccggtacgttaggtttaatcggtggtacgagtaaagngagtaagtacgttacttctacgtacgttagggtacgggtttaagg

SEQ ID NO: 351660 - DNA, 725 bp, Homo sapiens
  misc_feature: GZ8MTXP02JMGT1.39.87.H10.1.454.CMB.2.raw
  modified_base (691)..(691): a, c, t, g, unknown or other
  misc_feature (691)..(691): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatcgtgtaggagacagacgtcaccatcacttggccgggcaagtcagggactaattaaaatgatttagcctggtatcagacaagaaaccgaaggaaactccgtaaggtcctagatctagtgatcgccttcgtaaggtttggaaaggttcggggtaccctagtacgtaaggttccgaacggcggtacgtaaggttggaacgttccggtagggggtaacctaggttaaaccgtttttacccaaacccgtttacccgtaacctaaccccgtaacttacccgaaacccctaccggtcccgttacggaccccgggttaacgttaagttaaacggtttaacttttcgaaaccctttaaacgttttaattaccgtttaaacgttaacctaaaacttttaaactttttaacggtaccctttacgttacccgtactttccgttaaaccggttccgggaaacggtacggaacgtagggtacgagtaacggtaaacaaacggttacgtcggtacgtnaaccgtacgtacctcgttcttcgtctacgtcccg

SEQ ID NO: 351661 - DNA, 576 bp, Homo sapiens
  misc_feature: GZ8MTXP02JSY11.39.87.H10.1.454.CMB.2.raw
  modified_base (226)..(226): a, c, t, g, unknown or other
  misc_feature (226)..(226): n is a, c, g, or t
  modified_base (381)..(381): a, c, t, g, unknown or other
  misc_feature (381)..(381): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
  modified_base (515)..(515): a, c, t, g, unknown or other
  misc_feature (515)..(515): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctnagtgaaggtctcctgacaaggtcttcgtaggaactccaccctcaccgacgtactatatgactacgtggttgccgacgcggcccctaggacgaagggtcttggacgtggatgggagtggatacgaaccggtagagtcggtctacaactaattcgtnacacgtaagtaagtttcgagggtcgaggtcaaccgtgtaacgaccgacgggaactaccggtacctaacgtactaacgtaaccgaagtaccctaagactaggactacggacgaacgngtacgagacgngtaccgngtaacgcgacgtaccggatatagtggcgagagaagtgtacgtacgtctacttacgacgttg

SEQ ID NO: 351662 - DNA, 608 bp, Homo sapiens
  misc_feature: GZ8MTXP02H4X36.39.87.H10.1.454.CMB.2.raw
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (412)..(412): a, c, t, g, unknown or other
  misc_feature (412)..(412): n is a, c, g, or t
  modified_base (454)..(454): a, c, t, g, unknown or other
  misc_feature (454)..(454): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactccccaggtgcagctggtgcagtccgggactgaggtagaagaagccgtggggcctcgagtgaaggtctctgcaggcttgaggaactccaccctcaccgacgtactatatgcagttggtgcgacgcggcccnggaacaggtcttggagtggagtggatggatacgaaccggtanaggtgtacgtacaacttaaacttgacgtaccaacgtagtaacgttcgagggtcacgggtcaacgngtacgaccgagactacgtcaagtacagtacacgtaccctaanaggtacgtaacagggtaccgaacgtagggtactaggaactacgttcgaaccgaaaccggaccgtacgggttccgtttaagtaactttaagttcggagacggaagtaagaacgttacgtacggtactttccgttaacgtttaacggtttaagggg

SEQ ID NO: 351663 - DNA, 586 bp, Homo sapiens
  misc_feature: GZ8MTXP02G2T38.39.87.H10.1.454.CMB.2.raw
  modified_base (248)..(248): a, c, t, g, unknown or other
  misc_feature (248)..(248): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcaggtccggatggaggtgaagagccgtgggcctgagtgaggtctcctgcaggtctcgnggaactccaccctcgaccgacgtctatatgactagtggtcgcgacgacggtccccaggacgaaggtcttaggaggtggagtgggatgactacgaagtacgngtgtcagaactaatntcgacaacgtagtagttcgagggacacgggtaccacgacgtcggaaccgaggacctacgtaccagtaccaagtacncgtacctanagtacgaacgtgacgagagactagaggactcgacgacgtaccgtacggtacgttagttacgttagttaggacggtacgaagtagtaagtacggtaacgtttaccttacgttaccgttaggtttacggtttaaggggg

SEQ ID NO: 351664 - DNA, 741 bp, Homo sapiens
  misc_feature: GZ8MTXP02FVTBD.39.87.H10.1.454.CMB.2.raw
  modified_base (251)..(251): a, c, t, g, unknown or other
  misc_feature (251)..(251): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccggactgaggtgaagagccgtggggcctgagtgaaggtctcgtgcaaggtcttcgnggaatccaccctcaccgacgtctatatgactacgtggttgccgacgacggccccctagggaaccgaaggggtccttggaggtacgggtagtgggggtattacgggatacggaaaccgggtaacgtacggttcgggttacctaccgaaagttaaaacgtttacgtcggtaccgaaacggtaaacggttaaaacgggttttccgggaaacgggggtcccggtaaacgggggtttaacccaaacccgttaaggaacccgggaaacccggtaaacgggggaacccttaacccgggtacccctaaagttacccgtaaaagttaacccgaacggtaccccttaaacgacggtttacggaaaacgttcggaacggacggaaacggtccgtaaggagtaccgtcgtaacggaccggtacgaaccggttcggtagtttacgtagtcggtacgacgagagtaagtcgacgttactcgttacgtacgttacggttacgggg

SEQ ID NO: 351665 - DNA, 557 bp, Homo sapiens
  misc_feature: GZ8MTXP02HL5H3.39.87.H10.1.454.CMB.2.raw
  modified_base (252)..(252): a, c, t, g, unknown or other
  misc_feature (252)..(252): n is a, c, g, or t
  modified_base (483)..(483): a, c, t, g, unknown or other
  misc_feature (483)..(483): n is a, c, g, or t
  modified_base (516)..(516): a, c, t, g, unknown or other
  misc_feature (516)..(516): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcaggtccgggactggaggtgaagaagccgtggggcctcagtgaaggtctctgcaggcttnggaactccaccctcaccgtacgtctatatcgactacgtggttgccgacgaccggcccctaggaacgaagggtcttaggaggtcggagtgggattggactacgaaccggtacgaggtcgtactacaactaattgcgacaacgagtaacgttcgagggcgagggtccaacgagtacgacgaggacacgtcatacaatacacgtacctaagagtagactgacgacgagctgganctgtacgacgcgacggtcgtagtagttacgtgnggtacgagtaagtatagtacgtactctacgttagtttaggg

SEQ ID NO: 351666 - DNA, 590 bp, Homo sapiens
  misc_feature: GZ8MTXP02FTC0F.39.87.H10.1.454.CMB.2.raw
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (358)..(358): a, c, t, g, unknown or other
  misc_feature (358)..(358): n is a, c, g, or t
  modified_base (428)..(428): a, c, t, g, unknown or other
  misc_feature (428)..(428): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagctggggcctcagtgaaggtctcctgcaaggcttctggaatcgaccctcaccgacgtctatatgcactggttncgacncggcccctggacaggctgagtggagtgggatggatcgaacggtaacagtggtctacaactaaattgtnacagagtaagtttcgagggtcagggtcaaccagtcgaccgagggtacaccgtcatcaatacacgcctaanagtagaactggaagacccgaggtacctagaagtactacgtacgaaccgtaacgacggtaccggttacgtaactttaacggttggttacgaccggtaaaggaaggttaacgttacgggtaaagtttacccgtttactttaaccgtaaccggttttaaacgggg

SEQ ID NO: 351667 - DNA, 602 bp, Homo sapiens
  misc_feature: GZ8MTXP02HRQFA.39.87.H10.1.454.CMB.2.raw
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (383)..(383): a, c, t, g, unknown or other
  misc_feature (383)..(383): n is a, c, g, or t
  modified_base (491)..(491): a, c, t, g, unknown or other
  misc_feature (491)..(491): n is a, c, g, or t
tcagtcgcactagtcacgaccggtgctcgatttagcagtactgcgttgggtttggggagcatcacccagcaaccacatctgtcctctagagaatccccctgagagctccgttcctcaccatggactggacctggaggatcctcttcttggtggcagcagccacaggagcccactcccaggtgcagctggtgcaggtccggatggaggtgaagaagccgtgggcctnagtgaagtcnctgcagcttcnggaactcaccctcaccgacgtctatatgacacgtggttcgccgaacgtaccggccccgtagggaacgtaagggtcttaggagtggagtgggaactggactacgaaacggtaacagtcgacttacaaactaaattgngacaatagtaaagttcgagggtcgaggtacaacgagtgaccgaggactacgtacaatacaatacaagcctaaagagttaagaacaggaacgcgaacggtataggaagntacgaagaaccgtacgaccggtaccgtagttaaagtttaacgtcggtacggtacgaagtaaaccggtatacggtaaacgtttacttaccctttaagttaacgtttaagggg

SEQ ID NO: 351668 - DNA, 599 bp, Homo sapiens
  misc_feature: GZ8MTXP02F8J2I.39.87.H10.1.454.CMB.2.raw
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (571)..(571): a, c, t, g, unknown or other
  misc_feature (571)..(571): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcgagtgaaggtctccgtgcgaagtcttctaggatccaccctcgaccgacgtcctatatcgccacgtggttcgcgacgaccggccccgtggaacgtagggcttgagggtggagtggagtggatacgaacggtacngtgtcanaacgtaattgtagacaactaggtaacgtttacgacgggtactagggtaccaaccgtagtaacggaccgtaaggaccgaccgtaccaacttacgaaactacgaaccgtacctaaacgacgtacggaacgtacggagacgaggtgacgaagctacgagtaccggaccgtacggtcctaggttacttagtcgtagcgaagaagtacgngtacgtcctttacgtacgtactttaggg

SEQ ID NO: 351669 - DNA, 587 bp, Homo sapiens
  misc_feature: GZ8MTXP02FYQVK.39.87.H10.1.454.CMB.2.raw
  modified_base (226)..(226): a, c, t, g, unknown or other
  misc_feature (226)..(226): n is a, c, g, or t
  modified_base (558)..(558): a, c, t, g, unknown or other
  misc_feature (558)..(558): n is a, c, g, or t
tcagtcgcactagtcacgaccggtgctcgatttagcagtactgcgttggggtttgggggagtcagacccactcaggacacagcatggacatgagggtccccgctcagctcctggggcttctgctgctctggctcccaggtgccagatgtgccatccagttgacccagtctccatccctcctgtctgcatctgtaggagacagagtcaccatcacgttcgccggganaagtcgaggactaattaaaatgtattagctggtatcagacaagaaacaggtaaactcgtaagtcctagatctatgatcgccttcgtaggttaggaacggtcgggtacccagtacgtaaggtccaggcggacgtaggtgtacgtcggtgggactagtactttaccactctaccacctactaccaccgacgtccgtgacccggtctaggttaattactttacgacttaacttattacgtataacctaaatttatttacgttcttacgtcctatcgttaacggtcgggaggacgtaacgaggtagacgtacaaacgaaacgacgttgcggtaacncgacctacgtacttctcgtacctactccg

SEQ ID NO: 351670 - DNA, 716 bp, Homo sapiens
  misc_feature: GZ8MTXP02GP1J8.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtggggcctcgagtgaaggtctacctgcgaaggtcttcgtggaactccaccctcacccgacgtctatactgacactggttgaccgacgtacgggccccctagggaccgaaaggggtcttaggacggttggaagtggggaagttcggaagtaccgaaaaccgggtaacgtaggtcgggtacctactaacttaaaagttcgtagacctaacgtaagggttagtttacggaaacggggcgtaacgggggttaccaacccgtagtaacggacccggaacgggggtaccaaaccggtcctaaacgtacaaaaccgttaacgaaccggacttaaaccgtacggtacggtaaccgtaggacccgtacgacggtcgtaaggaacgtacgttcgtaacggaaccgtacgtaacccggggtcgttaagttaacgtaagtttccggaggttacccgaaggtaaccgagtacggtaacttaccgttacgtttaaccgttacgtttaacggggg

SEQ ID NO: 351671 - DNA, 722 bp, Homo sapiens
  misc_feature: GZ8MTXP02HC9R9.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtagaagaagccgtggggcctcgaggtggaacggtctccgtgcgaaggtcttcgacggaactcccaccctacgacccgtacgtactatatcgctacgttggttcggaccgacgaccggccccgtaggaacgtaggggtcttggaggtggtaggtgggagtggaactacggtaaacggtaacgtacgtcggtactacaaacgtaaattagtacgacaacgtaaggtaaacgtttcgaagggggtacgacgggtaccaaccgtagtacggaccgaacgggacaccgtacaacgtacaaacgtacgacgacctaaacgacgttaaggaacgttaggacgacggtaggtaccgtagtaacgtacgtacgtaaccggaacggtaccgtaaccgggttaccgttagtttaaacggtttacgttaggtacggtaacggtaacggtaaggtaacgttaacgggtaactttacgtttaccgttaacgtttaacggtttaacggggtttacggggttttaaacggggg

SEQ ID NO: 351672 - DNA, 562 bp, Homo sapiens
  misc_feature: GZ8MTXP02I9SR6.39.87.H10.1.454.CMB.2.raw
  modified_base (246)..(246): a, c, t, g, unknown or other
  misc_feature (246)..(246): n is a, c, g, or t
  modified_base (474)..(474): a, c, t, g, unknown or other
  misc_feature (474)..(474): n is a, c, g, or t
  modified_base (544)..(544): a, c, t, g, unknown or other
  misc_feature (544)..(544): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactccccaggtgcagctggtgcagtccggactgaggtgaagaagcctgggcctcagtgaagtctctgcaaggcttcnggaatccaccctcaccgacgtctatatgcacgtggtgccgacacgggccccctggaacaaggggcttagaggtggagtggggatggatacgaaacggtaacgagtggtactacgaactaaaattctgacaacgtaaggtaaagtttccgaagggctaggggtaccacgagtacggaaccgagggaccacggtaccaatacaactacacgtacctacgagtacggtacngaagcgaaggctagagatcgagacgacgacgggtcctagtattatgtcgacgagagaagtagattacgtnttactacgtagttagggg

SEQ ID NO: 351673 - DNA, 549 bp, Homo sapiens
  misc_feature: GZ8MTXP02FIJBH.39.87.H10.1.454.CMB.2.raw
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (358)..(358): a, c, t, g, unknown or other
  misc_feature (358)..(358): n is a, c, g, or t
tcagtcgcactagtcacgaccggtgctcgatttagcagtactgcgttgggtttgggggcatcacccagcaaccacatctgtcctctagagaatccccctgagagctccgttcctcaccatggactggacctggaggatcctcttcttggtggcagcagccacaggagcccactcccaggtgcagctggtgcagtccgggactgaggtgaagaagccgtggggcctcagtgaagtctcctgcaaggcttctggaatcaccctcaccgactctatangcactggtncgacacggcccctaggacaaggcttggagtggatgggatggatacgaaggtaacagtgtctacgaactaaattntgacacagtaagttcagggcagggtcacatgaccgaggacacgtcatacaatacacgtacctacaagtgaactgacgcgaggctaggagtctacgtgaacgacgacggtccgttagttaactttagttacggtgaacgaggaagtaagtacgtacggttactcgtttacttaacgttacggtttacggggg

SEQ ID NO: 351674 - DNA, 649 bp, Homo sapiens
  misc_feature: GZ8MTXP02IVMMC.39.87.H10.1.454.CMB.2.raw
  modified_base (106)..(106): a, c, t, g, unknown or other
  misc_feature (106)..(106): n is a, c, g, or t
  modified_base (201)..(201): a, c, t, g, unknown or other
  misc_feature (201)..(201): n is a, c, g, or t
tcagtcgcactagtcacgaccggtgctcgatttagcagtactgcgttgggtttgggggcaggagtcagacccactcaggacacagcatggacatgagggtccccgntcagctcctggggcttctgctgctctggctcccaggtgccagatgtgccatccagttgacccagtctccatcctccctgtctgcatctgtagganacagagtcacatcattgccggcaagtcgagggactaattaaaatgtattagcctggtatcagacaagaaaccaggaaacctctaagtctgatctatgatcgcctacgtagtttacggaaacggttcgggtacccctagttacccgtaaagggtttccgaagggtcccggtacgtaaagggttgggacgttccgggttaaggggaccgtaacgttacgttttccaaaccgttcctacaaccacttaccaccgtacgtccctaggcccgggtcctaaggaacgttatttcgaacttaaactttacgttactcgttactaaactttaatttacgttacttactccggtacttacgtaacgtttcgggacggtaacggtacgtaaaggggttacgtaaacgtactacgtaaaaccgtgtagtcgactacgtacacgtacttactacgtttac

SEQ ID NO: 351675 - DNA, 539 bp, Homo sapiens
  misc_feature: GZ8MTXP02GTWOU.39.87.H10.1.454.CMB.2.raw
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgatttagcctggtatcagcagaaaccaagggaaaactccgtaaaggtcctgatctatgatcgcctcaggtttaggaaagtggggtcccatcgaaggttccagcggcaggtggatcgtggggacaggtatttcactctcaccatcaaccngcctgccggactagaagtntttagacttaacttattactatactaaacttatttaattctactccgtctacgtacgttcgggacggaggacctaaggtcgggaatacgtacaaacgtaacgtgaggactgcactactctctctactcc

SEQ ID NO: 351676 - DNA, 578 bp, Homo sapiens
  misc_feature: GZ8MTXP02GJIF9.39.87.H10.1.454.CMB.2.raw
  modified_base (283)..(283): a, c, t, g, unknown or other
  misc_feature (283)..(283): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
  modified_base (422)..(422): a, c, t, g, unknown or other
  misc_feature (422)..(422): n is a, c, g, or t
  modified_base (457)..(457): a, c, t, g, unknown or other
  misc_feature (457)..(457): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgaggtccgggactggaggtgaagagccgtggggcctcgagtgaaggtctctgacgaaggtcttcaggaactccaccctcgaccgagtctanagtcgctacgtggtcgacgacgacggccccgtggaaccgaggtacgttggagtggagtgggatggatacgaaccggtagngtgtactcgaaactaagttcngacaacgtagtaattcggagggcgtaacggtccaacgntacgacgaggacacgtacatacaatcacgacctanagtacgatcggaagcctagggctaggacgatacgtacgacgacgtacggccgttagttaagttcgttaggacgtaggtagaagtcgtagtaacgtcctttacgttacgttacggtttaggg

SEQ ID NO: 351677 - DNA, 634 bp, Homo sapiens
  misc_feature: GZ8MTXP02G7VIP.39.87.H10.1.454.CMB.2.raw
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (575)..(575): a, c, t, g, unknown or other
  misc_feature (575)..(575): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccggactgaggtgaagagccgtggggcctnagtgaggtctcngcagcttcnggaatccaccctcaccgacgtctatatcgcacgtggttgcgaccgaggcccccgtaggacgaagggtccttagaggtcggagtggggatggatacgaaacggtaacgacgtggtcctacgaacgtaaattagtcgcaacgtaaggtaacgtttaccgacggggtacgtacggggtaccaaccgtagtaccggaaccgaaggggacctacgtaccaattaccaaataccacgaccctagagtacgtactggatcgagcgtaggatacttacgacggaccgaacgacccggtacgttagttaagtttaacgttggacggtacgaagtaggtaanaaggttaacggttaccttacgttaccgttacgtttaagggtttacggggtttaaacggg

SEQ ID NO: 351678 - DNA, 658 bp, Homo sapiens
  misc_feature: GZ8MTXP02HCASD.39.87.H10.1.454.CMB.2.raw
  modified_base (288)..(288): a, c, t, g, unknown or other
  misc_feature (288)..(288): n is a, c, g, or t
  modified_base (364)..(364): a, c, t, g, unknown or other
  misc_feature (364)..(364): n is a, c, g, or t
  modified_base (388)..(388): a, c, t, g, unknown or other
  misc_feature (388)..(388): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccggactgaggtagaagaagccgtggggcctcgaggtgaaggtctcctggcaagggtcttcgtaggaactccaccctcaccgtacgtctatntcgcacgtggtcgcacgcggtccctggaacaaggggtcttaggacgtaggagtgggatggactacgaaacggtacngttcggtactacaaactaagttanagtaccaaagtagtaagtttacgaaggggtctaagggtacccaaccgtaagtcggaaaccgaggggacctaacgtaccataacaactacgaccgtacttaaacgagttacgaaactggaaagaacccgtaggtacgtagaacgtacgtaaccgacgggaaccggtaacgacccgggttaagttaagttacgttaaacggttcggtaacggtaacgaaaggtaacgtaggtaacgtttacttaccgtttaacgttacggtttaaggtacgg

SEQ ID NO: 351679 - DNA, 667 bp, Homo sapiens
  misc_feature: GZ8MTXP02HY1J9.39.87.H10.1.454.CMB.2.raw
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (666)..(666): a, c, t, g, unknown or other
  misc_feature (666)..(666): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtagagacagatcacatcactgccgganaagtnaggacaataaatgattagctaggtatcagacaagaaaccgaaggaaactctaagtctatatctatgactcgtaccttaccgtaaggtttagggtaaacggtcggggtaccctaagtacgtaaggttccacggtcggacgtaggtggagttcggtaggggactagttacttaccgaaccttcaccaccctaactccaaacccgacggtcccgttaggaccccgggttacttacggtaaactttacggtttactaacttaaacgttttactttacggtaacttaaacctttaaatttaaacgtttttaatacccttaacgtcccgtactttacgtacggtttaccggacggggttaacgaaccgttaagggtcggtaaacgacttaaacgaaaccggtagttcgtaggacttaacgaccttaactcgttactccttactttacccnc

SEQ ID NO: 351680 - DNA, 573 bp, Homo sapiens
  misc_feature: GZ8MTXP02HGY6C.39.87.H10.1.454.CMB.2.raw
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (356)..(356): a, c, t, g, unknown or other
  misc_feature (356)..(356): n is a, c, g, or t
  modified_base (552)..(552): a, c, t, g, unknown or other
  misc_feature (552)..(552): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtagganacagatcacatcactgccgganaagtcgaggactaattaaaagtgtattagcctaggtatcagacaagaaaccaagggaaaacctcgtaaggtcctagattctatgatcgcctccgtaggttacgggaaggtccgggtaccagtacgaggtccaggcggngtagtggatgagggacaggtattccactcactaccataccaccacgccagcgtcctaggattatttacactaactttagtactgtaacttaataaatttacttacttacgctacttactacggttcggacgggaacgggaaccgtaaggcggaatacgtaaacgaaaccgtactcggtagactaacgacgttaacncgttactcgttcctactcccg

SEQ ID NO: 351681 - DNA, 641 bp, Homo sapiens
  misc_feature: GZ8MTXP02F8X45.39.87.H10.1.454.CMB.2.raw
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (495)..(495): a, c, t, g, unknown or other
  misc_feature (495)..(495): n is a, c, g, or t
  modified_base (507)..(507): a, c, t, g, unknown or other
  misc_feature (507)..(507): n is a, c, g, or t
  modified_base (581)..(581): a, c, t, g, unknown or other
  misc_feature (581)..(581): n is a, c, g, or t
  modified_base (590)..(590): a, c, t, g, unknown or other
  misc_feature (590)..(590): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcgagtccgggactggaggtgaagaagccgtggggcctcgagtgaaggtctcctgcaaggtcttcgaggaactccaccctcaccgtacgtctanatgcagtggtcncgacgacggcccctaggacgaagggtcttaggacggtggagtggggatggactacgaaacggtagacggtggtcctacgaaactaaattagtcgacaacgtaaaggtaaagtttaccgaggggccgtaaggggtccctaaacgagtcggaaacccgaggggaacccacgttaccaacgtaacaaacgtacaaccgtcctaaanagtacggtaaancgagtaaccggaagccgttaggacgtactcgaaggaccgacgtacccggggtcgtttagtacgtttacgttggngacgggaanagtagtaaggtaacttacttcttacgtactaggttcgggtttaaaacgggg

SEQ ID NO: 351682 - DNA, 579 bp, Homo sapiens
  misc_feature: GZ8MTXP02FVD80.39.87.H10.1.454.CMB.2.raw
  modified_base (247)..(247): a, c, t, g, unknown or other
  misc_feature (247)..(247): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagccgtgggcctgagtgaagtctcctgcaaggcttgnggaactccaccctcaccgacgtctatactgactacgtggttgaccgacgacgggccccctaggaaccgaagggtcttggagtggagtgggatggatacggaacggtaccngtgctacaataaattngaccaagtaagtacgttcgacgggtcacgggtcaacctagtacgaaccgtaaggaccacgtacaacgtaacaagtaacacgtacctaacgagtacgactgagcgtagctagagtactgagacgcgtacggtcgtatagttagtcggtagtacgaggtagtaacgtggtaacgttaccttcttacgtacgtttacggtttaacgggg

SEQ ID NO: 351683 - DNA, 723 bp, Homo sapiens
  misc_feature: GZ8MTXP02GJ1ZZ.39.87.H10.1.454.CMB.2.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctcctgtctgcatctgtaganacagagtcacatcacttgccggnagtcaggctaattaaangtattgctgtatcagacaagaaccaggaaactcgtaacggtctgatactagtgtactcgacctacgtaggtttagggaacggttcggggtaccctagttacgtaaggttcccgacggtcgacgtagtggacttcggtggggaactacgttactttaccaccgttacaccgtaactaccgtaccgtaaacccgtacgtacccgtacgggtacccggtacccgttaagggtaaaccgtttacgtttttaccgaaccgtttaaaactttaccgtttaaacgttacggttaaaacccttaaacgtttaaactttttaacgtttaccttaaccgtttaccccggtacttaccggtttaccggtttaccgggaccggggtaaaacgggtaacccgttaaggggtaccggtagtaaaccgttaaccggtaaaacgtccggtagttacggcttaacggactaaccgtacgttcttacggttaccttacttaccgg

SEQ ID NO: 351684 - DNA, 599 bp, Homo sapiens
  misc_feature: GZ8MTXP02HSRMN.39.87.H10.1.454.CMB.2.raw
  modified_base (244)..(244): a, c, t, g, unknown or other
  misc_feature (244)..(244): n is a, c, g, or t
  modified_base (288)..(288): a, c, t, g, unknown or other
  misc_feature (288)..(288): n is a, c, g, or t
  modified_base (350)..(350): a, c, t, g, unknown or other
  misc_feature (350)..(350): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggttccagctggtgcagtccggatgaggtgaagagcctgggcctgagtgaaggtctcctgcaaggcttcnggaactcaccctcaccgacgtctatatcgcactggttcgcgacnccggcccctaggacgaaggtcttaggagtggagtgggagttggactacgaaacggttaacgnggtaccgtactactaactaaattcgagacgagtaacgttaagttacgaggtacgtacggtactaaccgagtacgaccggacgactaccgtactaactactaacgtacacgtacctagacgtagtacgtgacgcgagacgtacgacgtcgtacgacgacgacgacgttcgttagttacgttgtcgaggacgacgtacgtagtagtaacgtacgttacgttacgttacgttacggttacggttacggttag

SEQ ID NO: 351685 - DNA, 738 bp, Homo sapiens
  misc_feature: GZ8MTXP02GE7XR.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagaacgccgtggggcctcgagtgaaggtcctacctgacaaggtcttcgtgaactccaccctcaccgtacgtctatactcgactacgtggtcgaccgacgaccggtccccgtaggaacgtaacggggtcttagggagttaggagttgggagtaggtaactacggtaaacggtacgacggttcggtacctaacgtaaacgttaaaagttacgttacggacctaaacgtaaacggttaaaccggttttacgggaacgggggtacgtaaaccgggggttacaaacccgttaggttaacccggaaccggaacggggtaaaccacccggttaaccaacgtaccaaacgttaacgacggtaacccctaagtaacggtaacggtaacgtacggaacgtacggaacggtcgtaacggtaagtacgacgttacggaaccgtaccggtaaacgtccgtagttagttgtacgggtacgaacgtaggactacggtaataccgttacttacttacgtaagttacggtttacggggtttaaagg

SEQ ID NO: 351686 - DNA, 590 bp, Homo sapiens
  misc_feature: GZ8MTXP02JBPIW.39.87.H10.1.454.CMB.2.raw
  modified_base (254)..(254): a, c, t, g, unknown or other
  misc_feature (254)..(254): n is a, c, g, or t
  modified_base (357)..(357): a, c, t, g, unknown or other
  misc_feature (357)..(357): n is a, c, g, or t
  modified_base (548)..(548): a, c, t, g, unknown or other
  misc_feature (548)..(548): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagccccactccccaggtgcagctggtgcaggtccgggactggaggtgaagaacgccgtggggcctgagtgaggtctctgcaggcttgngaactccaccctcaccgctctatatcgctacgtggttcgcgacgaccggccccgtaggaaccgaaggggtcttggagtggagtgggatggatacgaacgtacngtcgtactacaactaattgtgacaagagttaagtttcggagggcgacgggtaccaacgtagtacggaccggaagggacctaccgtaccaagtacaaactacacgtacctagagtacggaactggaacgcgacgggctaggacgtacgtcgacgacgtacggaccggtacgttagttacttacggtgtacgngaagaagtaacgtggacttcgttacttacgtagtttacgggg

SEQ ID NO: 351687 - DNA, 542 bp, Homo sapiens
  misc_feature: GZ8MTXP02I9WCL.39.87.H10.1.454.CMB.2.raw
  modified_base (141)..(141): a, c, t, g, unknown or other
  misc_feature (141)..(141): n is a, c, g, or t
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctnttctggtgcagcagccacaggagcccactcccaggtgcagctggtgcaggtccggactgaggtgaagagccgtggggcctcagtgaaggtctcctgcaaggtcttcgnggaactcgaccctcaccgtactnatatgcactgtncgacagggcccctgacaaggcttgagtgagtggaatggactacgaacgtacagtcgtcacactaaaattngactaagagtacgtcgacggacacgtacacgagacgacgacgacgacgtacactacaacacacgactacgtacgtacgagagacgacgacgagagagacgacgtacgacgacgtacgtacgtacgtacgtagtacgtacgtacgtagtagtaagtacgtacgtactacgttacgttacgtacgtacgg

SEQ ID NO: 351688 - DNA, 675 bp, Homo sapiens
  misc_feature: GZ8MTXP02HW3Q4.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtagaagagccgtgggcctgagtgaaggtctccgtgacaaggtcttcgtaggaactccaccctcgacccgacgtctatatcgctagtggtgaccgacgaccggccccgtagggaaccgaaggggtccttaggtacggtggtaagtggggtaatacgggaactaccggaaacggtaacgacggttcggtacctactaaaccttaaaatttcgagacctaacgtaaaggttaacgtttccggaaggggtacgacggggttaccaaccgtagaccggaaacgacggggtaaccacccgttacaacggttacaaagtacccgaacggtaccctaagacgttaaggaaaccctaagcccgtaagggcctaggacaacgtcgacggaaccgacgtaccggtactagttaatttgtacggacgtagagtagagttgaacgttactacgttacaagtttacggtaggttaacggttaaag

SEQ ID NO: 351689 - DNA, 720 bp, Homo sapiens
  misc_feature: GZ8MTXP02G2IAN.39.87.H10.1.454.CMB.2.raw
  modified_base (253)..(253): a, c, t, g, unknown or other
  misc_feature (253)..(253): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccaactcccaggtgcagctggtgcaggtccgggactggagggtagaacgaaggtccgtggggccttcgaggtaggaaggtccnccgtgctaaggtcttcgtaggaacttccacccgtcaccgtacgtctatacgtcgactaccgtaggtcgacgtaccggacggtccccgtaggaaccgtaagggtcgttaggacggtgggtagttacggggagtcggacttacggacgtaccgtaacgttaacaaaggtacgaaaaacccgtaagaacggtacgttacggaactaaacgtaaccgtttaaagtttacccgaaggggtacaaggtacgtacaacgttacgaagtacgaacccaagaacgaccaaacacgaaacccgacgacgacgactacgtaccgtaacgacgtacggggtaaacttcggaaacggtaccttagggacctaacgttcgacggtaacctaaccgttaaacggactttaactaacgtttaggttacgcggtaacgtaacggaaacttaaaccttaaaaccgttcccttaacgtttaaaccg

SEQ ID NO: 351690 - DNA, 646 bp, Homo sapiens
  misc_feature: GZ8MTXP02GYZ1W.39.87.H10.1.454.CMB.2.raw
  modified_base (191)..(191): a, c, t, g, unknown or other
  misc_feature (191)..(191): n is a, c, g, or t
  modified_base (249)..(249): a, c, t, g, unknown or other
  misc_feature (249)..(249): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtncagtccggactgaggtgaagagccgtggggcctcgagtgaaggtctctgcaggtcttntggaatcaccctcaccgacgtctatatgcagtggtgcgacacggcccctaggacgaggtctggagtggagtgggactaggactacgaaccggtaacgagtcggtactacgtaaactaaagttcgtcgaacaaccgtaaggttaaacgtttcggaagggtccgtaacggggtccaaacgagtaccggaaccgtaacggggtacaccggtacctaacgtaacaaacttaccgaacgtaaccgtaacgacgttacgggaacgttaggacgtacgacggtactacgggaactacgtaccgtacgaaccggtaacggtacccgggtaccgtagtaccttaagtttacgtaggtacggagtaaggaacgtacgttaggtactttacctagtttaccttaacgg

SEQ ID NO: 351691 - DNA, 683 bp, Homo sapiens
  misc_feature: GZ8MTXP02JXD20.39.87.H10.1.454.CMB.2.raw
  modified_base (252)..(252): a, c, t, g, unknown or other
  misc_feature (252)..(252): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctctgcaaggcttgnggaatccaccctcaccgacgtctatatgcagtggtgcgacgacggcccctggacaagggtcttggagtggatgggatggatacgaaaccggtacaggttgtactacgaacaatttgcgacacgaagtaacgtttcgaggggtacgaacggggtcaacccgagtacggaacccgaaggggaccaaccggttccaaagttaccaaactaccgaacgtacccctaaagtacgttaggaaaccgttggaacgtaccgaacgggtaccgttagggaacgtaaacgttccgtaaaggaaccccgggaaaccgtacccgggggttaccgttacggtttaaacgtttaaacggtttggaccggtacgggtaaaggtaacgtaacggttaggtaacggtttaaccctttacgttttaaccgttaccgttttaaacggggg

SEQ ID NO: 351692 - DNA, 646 bp, Homo sapiens
  misc_feature: GZ8MTXP02IWCAM.39.87.H10.1.454.CMB.2.raw
  modified_base (354)..(354): a, c, t, g, unknown or other
  misc_feature (354)..(354): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagagccgtggggcctcgagtgaaggtctcctgcaggcttcgtaggaactccaccctcaccgacgtctatatgctacgtggtcgcgacgacggcccctaggacgaagggtcttggaggtggagtgggataggataccgaaaggtacnggtgtctacaataaattagcgcacgtaagtaagttcgaggggacagggtccacgatcggaccgagggacacgtacactacaactacgacgtcctaagagtacggaacgtgacgagacggtactaggaagtacgtacgtacggaaccgaaccggtacccgggttaccggttagtttaaacgtttacggtttacggtaggaccggtaaaggtaggttaacggttaaggtaaccggtttactttaccgtttacgttaaccggtttaggggtttaacgggggtttttaaacggggg

SEQ ID NO: 351693 - DNA, 725 bp, Homo sapiens
  misc_feature: GZ8MTXP02G0JEG.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggatgaggtgaagagccgtggggcctgagtgaggtctccgtgcgaaggtcttcgtggaactccacccctcaccgtacgtctatagtcgctacgtggttcgaccgacgaccggccccgtagggaaccgtaggggtcttaggaggtggagtggggatggactacgaaaccgggtacaggttcggtactacaaactaaagttcgacgacaacgtaagttacgtttacggaacggggtacgtacgggtaccaaacccgtagtacggaaccggacgggtaacctaccggtaccaacgtaactaaacgtaaccaacggtaccccttaaagaacggttacgggaaacgtacgggacgaccggtacggtacgtaggaacgttaccgttacggtacggaaccggtaaccggtacccggggttcggtttaacgtttaaggtttaacgtttcggggaaccggtacggtaagtaacgggtaggttaacggttaacgtttacccgtttaccgtttaaccggttagttttaaccggggg

SEQ ID NO: 351694 - DNA, 620 bp, Homo sapiens
  misc_feature: GZ8MTXP02ISKKJ.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagaagccgtggggcctcgagtgaaggtctctgcaggcttgtgaatcaccctcaccgacgtctatatcgcacgtggtgcgacgacggccccgtggaacgaagggtcttgaggtggagtggggatggaactcgaaaccggtaacgaggtcggtactacgaaacttaaagttgtgaccaagagttaaggtttcgaggggacgaggggtaccaacgtacgtacgaaccgaggggaacctccggtaacctacttaacaaacttacgacgtaccctaaacgacgttacggaaacctgggaacgacggaacggtctaggaacgtaacttcgacgaaccgacggtaccggtcgtagttagttagttcggacgcgtaagtaagtagtacgtacgtaccttctttactaggtttacggg

SEQ ID NO: 351695 - DNA, 622 bp, Homo sapiens
  misc_feature: GZ8MTXP02FZB2K.39.87.H10.1.454.CMB.2.raw
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagagccgtggggcctcgagtgaaggtctctgcaggtctcgtggaatcaccctcaccgcgtctatatgcactggttgcgtacgacggccccgtggacagggtcttggacggtggagtgggatggactacgaacccggtangtaggtctacaaactaaattgngacaacgtaagtaacgtttacggagggtacgtagggtaccaacccgagtaacggaccgaaggggacaccgtaccaatacaaatacgacgacctacagtacggaactaggagaccggagtaccgagtacgacgtacgacggacgacgtaccgggtacttacgttaactttaggttaccgtagggacgttaagaaggtacgtttaacggtaccgttactttaccgtttaacgttaccggttttaacgggg

SEQ ID NO: 351696 - DNA, 568 bp, Homo sapiens
  misc_feature: GZ8MTXP02IQL2Z.39.87.H10.1.454.CMB.2.raw
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggtcgcgacacggcccctggacaaggcttggagtggatgggatggatacgaacggtacaggtcgtacncaactaattngacaacagtaacgtttcgagggcagggtacacagtcgaacgagggaacacgtaccaatacaaacgtacacgacctaacgagtaggaactgagaccgagggctagagtatcgtacgacgacgtacggcgttagttacgtttagtggtacggtacgaaggacggtaacgacggtacgtttacccgaaggttacggggtaacttaaaggtacgg

SEQ ID NO: 351697 - DNA, 682 bp, Homo sapiens
  misc_feature: GZ8MTXP02GUCM9.39.87.H10.1.454.CMB.2.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactccccaggtgcagctggtgcagtccgggactgaggtgaagaacgccgtgggcctcagtgaaggtctcctgcaggcttctaggaactccaccctcaccgacgtctaatatcgctacttggttcgcgaacgacggccccgtaggaaccgaaggggtcttaggacgttggagtggggatggactacgaaaccgtacgagtcggtactacgaactaaagttcgtacgacgtaaacgtaagttaacgttacggaacgggtacgtaacgggtaccaacccgtagtacggaaccggaagggaaacccaccgtaacgaactaacgaaactcgtaaacgtacctaagtaacgtacggaaacgtggacgtaccgaggtacgtaaggtaacgtaagttacccgtaaacggaaaccccgttacggaaaccgggtaccgtttaaacgtttaaagtttagttcgggacgtacggtaagaacgttacggtaaggtactacgtttacttacgttacggttaggg

SEQ ID NO: 351698 - DNA, 589 bp, Homo sapiens
  misc_feature: GZ8MTXP02GVV1E.39.87.H10.1.454.CMB.2.raw
  modified_base (229)..(229): a, c, t, g, unknown or other
  misc_feature (229)..(229): n is a, c, g, or t
  modified_base (432)..(432): a, c, t, g, unknown or other
  misc_feature (432)..(432): n is a, c, g, or t
  modified_base (467)..(467): a, c, t, g, unknown or other
  misc_feature (467)..(467): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctnagtagaaggtcctccgtgacgaaggtcttcgtaggaactccaccctcaccgtacgtctatatgctagtggtcgcgacgacggcccctaggacgagggtcttggagtggagtgggtataggactacgtaaaccggtacgagttgtactacgaaactaaattgacgactagacgtaagttcgagggtacgtagggtacaccgtanacgacgacggacaccgtacactacacacactacanagtacgagtagagacgagacgtagagtagtacgacgacggacgacggttcgtacgttactacggttggtacgacgtaagaagtacgtacgtacgttaccgttacttacgttaagtttacggg

SEQ ID NO: 351699 - DNA, 641 bp, Homo sapiens
  misc_feature: GZ8MTXP02JV6XV.39.87.H10.1.454.CMB.2.raw
  modified_base (199)..(199): a, c, t, g, unknown or other
  misc_feature (199)..(199): n is a, c, g, or t
  modified_base (313)..(313): a, c, t, g, unknown or other
  misc_feature (313)..(313): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggcctcccaggtgccaaatgtgacatccagatgacccagtcctccttccacctgtctgcatctgtagganacagagtcacatcacgttgccggcagtcagagtcttaagtgcttggttggcctggtatcgagacaagaaaaccgagggaaaccacccctaagccttccgtggtcctcgtggtcnccttacgtaggtttcgacgtaaggtcgggtaccctagtacgtaaggttccgaggtcggactaggtagaacgttcgtaggggaacaagtaacttcgacctctaccaccatcacgacaacgtcgacgcgtccgtggttacgttagtttacgacttaaactttagttactacgtaccatactaacttacttacttaaccgttacccttacgttacgtttacggacgtaacggggtaactaacgtacgtaagaaacgtaaacgtaaacgtaaaacggtacgttaaggtcggtaccttacggacctaaccgtacgtttaccttcgtttaaccc

SEQ ID NO: 351700 - DNA, 655 bp, Homo sapiens
  misc_feature: GZ8MTXP02IM4A7.39.87.H10.1.454.CMB.2.raw
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (284)..(284): a, c, t, g, unknown or other
  misc_feature (284)..(284): n is a, c, g, or t
  modified_base (343)..(343): a, c, t, g, unknown or other
  misc_feature (343)..(343): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactccccaggtgcagcctggtgcgagtccgggactgaggtgaagagcctggggcctcagtgagtctctgcagcttcngaatcacctcaccgactntatatcgctacgtggtcncgacacggccctaggacgaaggtcttgacggtggacgtgggatggatcgaaccggtacngtcggtcacgaactaattgtgacagtagtagttacggacgggtacacgggtacaacctagtacggccgtaaagggacctacggtactacgtacgaaacgttcaaccgtacttaaacgaacgtacgggtaaccttagggaaccgtacggtaccggacttaggaaacggtcttaaccggtacggaaaccccggttaggaacccgggtttaccggtacggttttaaattaacggttggttaccggacggtaaacggtaacgttaagtaggttacggtttaacgtttacccctttagttaaccggtttaacggggg

SEQ ID NO: 351701 - DNA, 598 bp, Homo sapiens
  misc_feature: GZ8MTXP02FGS4Q.39.87.H10.1.454.CMB.2.raw
  modified_base (191)..(191): a, c, t, g, unknown or other
  misc_feature (191)..(191): n is a, c, g, or t
  modified_base (408)..(408): a, c, t, g, unknown or other
  misc_feature (408)..(408): n is a, c, g, or t
  modified_base (499)..(499): a, c, t, g, unknown or other
  misc_feature (499)..(499): n is a, c, g, or t
  modified_base (527)..(527): a, c, t, g, unknown or other
  misc_feature (527)..(527): n is a, c, g, or t
  modified_base (565)..(565): a, c, t, g, unknown or other
  misc_feature (565)..(565): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggagcctcttcttggtggcagcagccacaggagcccactcccaggtgcagctggtncagtccgggactgaggtgaagagccgtggggcctcgagtgaacggtctccgtgcaaggtcttcgtggaactccgacccctcgacccgtacgtctaatatcgccacgttggttcgacgaacgcggcccccgtgggaaccaaggggtcctttaggaggtggagtcggggataggactacgaacccggtaacaggtggtacctacgaactaaaagtttcngacaacgtagtaacgtttcgagggctacggggtacacccgagtacgaaccgagggaccacgtaccaacttacaaactaccgagtccctaanacgtacgaactgaagcgacggctagganacgtcacggactacgacgcgttatattacgtgcgcganaagatacgtagttactcttacgtacgtttaggg

SEQ ID NO: 351702 - DNA, 638 bp, Homo sapiens
  misc_feature: GZ8MTXP02GE95Y.39.87.H10.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (599)..(599): a, c, t, g, unknown or other
  misc_feature (599)..(599): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttgacccagtctccatcctcctgtctgcatctgtagganacagagtcacatcacttggccggnaagtcgaggactaattaaaatgtatttacgcctggtatcagacaagaaaccgaaggaaaacctcgtaaggtcctagatacgtatgatcgtacccttacgtaggtttagggaaacggttcgggtacccaataccggtaaggttccgaggcggtacaggtggtacgtcgtggggaactagtatttccacctcacaccacgtcaaccgcgtccgtgcccgtactaggtaacttactttgaaccttaagttattaaccgtattaaacctaaattaaattttaacttcgtaaccttcccgtacttacgtaacggtttcggggacggtaacgggaaccgtaagggtaccggaaataacgtaaaccaaaacggtactggtaccgngtaacgaccacctattccgttactaccctacgttacccg

SEQ ID NO: 351703 - DNA, 767 bp, Homo sapiens
  misc_feature: GZ8MTXP02GQ3OW.39.87.H10.1.454.CMB.2.raw
  modified_base (257)..(257): a, c, t, g, unknown or other
  misc_feature (257)..(257): n is a, c, g, or t
tcagtcgcactagtcacgaccggtgctcgatttagcagtactgcgttgggtttgggggcatcacccagcaaccacatctgtcctctagagaatccccctgagagctccgttcctcaccatggactggacctggaggatcctcttcttggtggcagcagccacaggacgcccactcccaggtgcagctggtgcgaggtccggactgaggtgaagaagccgtggggcctcgagtgaaggtctcctgcgaaggtcttcgnggaactccaccctccaccgacgtctatatgactacgtggttcgccggacgacggtcccccgtaggaacgaacggtcgtttggaggtagggagtaggggtagtacgggacgtacggtaaaccgggtaaccgtaggtacgggttactactaaacttaaaattacgtcggactaaccgtaaaggttacgtttacgaagggggtacgtaggaaacccgtacgaaagtaccggaaacggacggggaaccctacgtaacccgtaacttaaccgaaactaccaacggacctaaacgtaagttacgggtaaacgaggaacggacgtacggtacgtaggtaacgtacgtaccgtacggaaaccgtaccggtaccgggtacggtttaacgtttaacggtttaggtacgggttacggtaacggtaacggttaaacggggttaaacggggttaaaacgggtttaaacggttttaacggttttaccggttaacggtttacccgggttttaacccggtttacgg

SEQ ID NO: 351704 - DNA, 716 bp, Homo sapiens
  misc_feature: GZ8MTXP02IMOIR.39.87.H10.1.454.CMB.2.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaacgngtcccccccccccggggntcgaggtgaaggtctccgtgacgaaggtcttcgtaggaacttccaccctcaccgacgtctagtatcgcactggttcgcgacgacggccctaggacgtaagggtcttaggacggtggtagtgggagtaggtaacgtacgaaacccggttaacgaggttacggtactacgaaaccttaaaagttacgtggaccaaacgttaagtaaacggtttcggaggggaccgtaggggtacacccgtagtaccgaccgaagggacctacccgtacacttaacaacgtaaccacgtaaccctagaacccgtaggaattacggaacgccgaaggtcgtaaggaaggtactttacgaacggtaacccgtacgaccccgggttacgttagtttaaacgttaacgttcgggttaaaccggacgttaacgggaacgttagttaacgggttactaaaccgttttcccgtttaacgttaaccggttttaacggggg

SEQ ID NO: 351705 - DNA, 765 bp, Homo sapiens
  misc_feature: GZ8MTXP02HTAEA.39.87.H10.1.454.CMB.2.raw
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtagaagagccgtggggcctcgagtagaaggtctcctgcgaaggtcttcgtagaatccaccctcaccgtacgtctatatgcacgtggttgcgtaccgacggtcccccgtaggaaccgtaagggtcgttaggacggttgggagtggggtaattagggaactaacggaaaccggtaaactacggggttacggttacctaaccgtaaacttaaaatttacgttacggaccctaaacgtaaaggttaaacggttttaccgggaacgggggtaccgtaaacgggggtttacccaaacccgtaaagttacccggaaacccgggtaacggggaaccccgtaaccggttaacccgaacttaaccgtaaaacttaacccgaacgtaaccccgtaaacgtaaacggttaacgggaaccgttagggaacggtacggaaccggtcgtaaggaacggtacgtcgaacggtaaccgaaccggaccggtaccgttaaggttattaacggttagtacggtagacgagtagtaagtacgttacttaccttagtaccgttaggtttacgggtttaacggg

SEQ ID NO: 351706 - DNA, 666 bp, Homo sapiens
  misc_feature: GZ8MTXP02H3Z8D.39.87.H10.1.454.CMB.2.raw
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtgaagaagccgtggggcctnagtgaggtctctgcaggctcnggaatcaccctcaccgacgtctatactgcactggttcgcgacgacggccccgtagggaccaaggggtcttaggaggtggtagtggggatggatcgaaacggtaacgngtcggtacacgaactaaattncgacaagtagtaagttcgaggggactagggtcaccagtacggacccgaagggtaccacggtcaacgtacaaactacgaacgtaccctaaacaacgtcgggaaacctgggaacgacggacggtaccgtaggaacgtcgttaacgtacgggtaaccgaaccggtaccgggtaccggttttacgggtttaaacgtttacgttacggggttacggtacgggtaaagtaaaggttggttaacggtaacggtttaaaccttcggtttttaccctaaaacggtttttacggggg

SEQ ID NO: 351707 - DNA, 639 bp, Homo sapiens
  misc_feature: GZ8MTXP02H9YOO.39.87.H10.1.454.CMB.2.raw
  modified_base (226)..(226): a, c, t, g, unknown or other
  misc_feature (226)..(226): n is a, c, g, or t
  modified_base (485)..(485): a, c, t, g, unknown or other
  misc_feature (485)..(485): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttctggtggcagcagccacaggagcccactcccaggtgcagctggtgcagtccggactgaggtagaagaagccgtggggcctnagtgaaggtctcctgcaaggcttcaggaactcgaccctcaccgacgtctatatgcacgtggttgcgacgcggcccctaggaccaagggtcttaggacgtggtagtgggagtggaataccgaaacggtaacaggtggtactactaaacaaagtttcagtactaaccgtaagtaacgtttcggagggtacgtacgggtcacccgtagtacgaacggaacggacctaccggttacaacgtaacaactaccaaggtccctaanagttacggaaacctggacgaccgagactagaagtatccgagaaccgacgtacggtaccgttagttaaacgttacgtttagtcggaaccggtaaacggaaggtacggtttaaggacgttttaaccgtccctttaaggtttaaccgtttaacgggg

SEQ ID NO: 351708 - DNA, 649 bp, Homo sapiens
  misc_feature: GZ8MTXP02HDXBB.39.87.H10.1.454.CMB.2.raw
  modified_base (244)..(244): a, c, t, g, unknown or other
  misc_feature (244)..(244): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcagtccggactgaggtgaagaagccgtgggcctcagtgaagtctctgcaggctntgactcacctcaccgacgtactatatcgcacgtggtcgccgacgacggtcccccgtaggacgaagggtcttaggaggtagggagtggggtagtaggtacgtaccggtaaacggtaaccgaggttcggtacgtactaaataaacttagtcgacgtaacgtaagtaagtttcgagggacgacgggtaccaacgagtacgaccggtaaggacccacggtccaagtaccaaatacaacgtacctacgaagtacggaactagggacgacggaggaccgtaggaacgtacgtacgtacggaccgacggtaaccgggtccgttaggttaacgttaggtaccggtagaaccggtaggagtaaccgtaggtaaccggtttacttacgtttaccgtagttacggtttaacggggg

SEQ ID NO: 351709 - DNA, 710 bp, Homo sapiens
  misc_feature: GZ8MTXP02FK9B6.39.87.H10.1.454.CMB.2.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcagtccgggactggaggtgaagacgccgtggggcctgagtgaaggtctcctgcgaaggtcttcgaggaactccaccctcaccgtacgtctatatcgacacgtggttgccgacgacggtcccccgtaggaacgaacggggtcttaggacggtgggtagtggggactgggaactaccggaaacgggtaacccgtaggttacgggtacctactaaaccgttaaaattacgtgaccaaacgtaaaggtaacgtttcgaaggggtcgtaaggggtaccaccgtagtacggaacccgaagggacctaccgtacccgaactacgtaaaacgtacgaaccgtaccgtaacgaagttacgggaactaggacggtacgaaaggtccgtaggaacgtacgttacgacgaaccggtaacggaccggtcgttaagttacgtttaggttacggtacgtaacggaaggtaagtaacgttaaggtaacggtttaccttacctttaacggttaaccggtttagggttttaacggggg

SEQ ID NO: 351710 - DNA, 637 bp, Homo sapiens
  misc_feature: GZ8MTXP02GMS32.39.87.H10.1.454.CMB.2.raw
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (387)..(387): a, c, t, g, unknown or other
  misc_feature (387)..(387): n is a, c, g, or t
  modified_base (573)..(573): a, c, t, g, unknown or other
  misc_feature (573)..(573): n is a, c, g, or t
tcagtcgcactagtcacgaccggtgctcgatttagcagtactgcgttgggtttgggggagcatcacccagcaaccacatctgtcctctagagaaacccctgagagctccgttcctcaccatggactggacctggaggatcgtcttcttgggtggcagcagtcacgaggacgccccctcccgaggtgaaattgggtgcagtcgtggctttgaggtgagaagcgtgggcctctcgtagaaacgtccctggccacggtcttcgaggtactacatctanaactctatacatccgacgtggcnccgccgacgcccgtgcgaaggccgtgaggtgggtcggctaccgactaccaaaccccagtaccgtacggacgtaacccaaacgaaactcnggacctaacaaacgtaccttcgggacgcgtaaccggacaacccgtaagacccgacccggaactccggacccataacaacgtaccacgtactaactagtaacgaccttagaaacgtagtaaacgtaaagtccgtagaaacgaccgtacggtccgtaactagttacgagacggtacgaggtgaaccgngtaaccgtacgtaagggacgggtataacggcgacgtagtacgttacgagtttcggtactttaag

SEQ ID NO: 351711 - DNA, 491 bp, Homo sapiens
  misc_feature: GZ8MTXP02FX1TE.39.87.H10.1.454.CMB.2.raw
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
tcagtcgcactagtcacgaccggtgctcgatttagcagtactgcgttgggttgggggagcatcacccagcaaccacatctgtcctctagagaatcccctgagagctccgttcctcaccatggactggacctggaggatcctctcttggtggcagcagcacaggagcccactcccaggtgcagctggtgcagtccgggactgaggtgaagagctggggcctcagtgaaggctcctgcaaggctctggatcaccctcaccgacgtctactatgcacgtgttgcgacacggcccctggacaagggcttgagtggatggggatggatcgaaccggtaacagnggtctcacaaattngcanagaatttcgagggnagggtcacatgacagggacacgtcatnaatacagtccacatgactagagcaggctagacgancgtgacgactacggccgtagattatgtgcgagaagatgacgtactcgtactacgttagg

SEQ ID NO: 351712 - DNA, 563 bp, Homo sapiens
  misc_feature: GZ8MTXP02GYVJP.39.87.H10.1.454.CMB.2.raw
  modified_base (223)..(223): a, c, t, g, unknown or other
  misc_feature (223)..(223): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (525)..(525): a, c, t, g, unknown or other
  misc_feature (525)..(525): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagagcctgggcctnagtgaaggtctcctgcaaggcttctggaatcaccctcaccaacgtctatatgcactggttgcgacgacggccccctaggaccaaggggtcttagagtcggattgggatggatcgaaccggtacngtggtactnacaaattntcganaacgtagtaaggtttacggactagggtccacgagtacgacgaaggaccacgtccatacgaatacacgacttacagtagaactgacgacgaggctagacgtattccgagacgacacggccttaggtacttaagtggtacgacgtagaagtaaggtanaacggttactacgtttactaaccgttacgtttacgggg

SEQ ID NO: 351713 - DNA, 661 bp, Homo sapiens
  misc_feature: GZ8MTXP02F5JCS.39.87.H10.1.454.CMB.2.raw
  modified_base (320)..(320): a, c, t, g, unknown or other
  misc_feature (320)..(320): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccaaatgtgacatccagatgacccagtctccttccaccctgtctgcatcgtgtaggagacagagtccaccatctacgttcggcccgggaccagtcaagtagtcttaataggcgttagggttcggcctaggtatcagacaagaaaccgagggaaacacccctaagcctccgtggtctcgnggtctcctctagtttgacgaaggttccgggaccagtacgtaggttccgagcggacagtagaacgtcgtaggggaacaggtaactcctactactaccactacncgagacgtaacgngacacgccgttaggtnttagtttagacttaaattacgttactacgtacctagtaccttattaacctttaacgttaacctttaccctttacgtttaccggtttacggaccggtaaccggggaaaccttaaacggaccgtaaagtaaacgaaaccgttaaaacgaaaaacggtaccgttaggttaacccggaacttaccgacctaacctactaccgttatttaccccg

SEQ ID NO: 351714 - DNA, 671 bp, Homo sapiens
  misc_feature: GZ8MTXP02JQORX.39.87.H10.1.454.CMB.2.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (454)..(454): a, c, t, g, unknown or other
  misc_feature (454)..(454): n is a, c, g, or t
tcagtcgcactagtcacgaccggtgctcgatttagcagtactgcgttgggtttgggggcaggagtcagacccactcaggacacagcatggacatgagggtccccgctcagctcctggggcttctgctgctctggctcccaggtgccagatgtgccatccagttcgacccagtcctccactccctccctgtctgctatctgtaggatacagagtccacatcacgttgcccgganaagtcgaggacaattaaagtntagttagcctaggtatcgagacaacggaaaccgagggtaaacctccgtaacggtctcgatacttaatgtacgtcgtacccttacgtaggttaggaaacgttcggggtacccctagtacccggtaggttacgcggacggtacgtaggtagagtcgtacggtaagtacgttactttaacgcttacccgtaactacctaaccnccgaaccgtcgtccgtcggaccggtaccttagtaacgttacgtttacgtaacttactttacttactacgttaacttaaactttaactttagtttccgttaactcccgttacgttacggttacggtacggggtaccgggtaacggtaaaccggtagggtacgaaagtaacgtaacgaacgttcgtaggcgtacaccgtacgtactacgttcgtactac

SEQ ID NO: 351715 - DNA, 592 bp, Homo sapiens
  misc_feature: GZ8MTXP02J4Y1U.39.87.H10.1.454.CMB.2.raw
  modified_base (244)..(244): a, c, t, g, unknown or other
  misc_feature (244)..(244): n is a, c, g, or t
  modified_base (378)..(378): a, c, t, g, unknown or other
  misc_feature (378)..(378): n is a, c, g, or t
  modified_base (426)..(426): a, c, t, g, unknown or other
  misc_feature (426)..(426): n is a, c, g, or t
  modified_base (462)..(462): a, c, t, g, unknown or other
  misc_feature (462)..(462): n is a, c, g, or t
  modified_base (482)..(482): a, c, t, g, unknown or other
  misc_feature (482)..(482): n is a, c, g, or t
  modified_base (500)..(500): a, c, t, g, unknown or other
  misc_feature (500)..(500): n is a, c, g, or t
tcagtcgcactagtcacgaccggtgctcgatttagcagtactgcgttgggtttggggatcaccagcaacacatctgtcctctagagaatcccctgagagctccgttcctcaccatggactggacctggaggatcctcttcttggtggcagcagccacaggagcccactcccaggtgcagctggtgcaggtccggactgaggtgaagagcctggggcctcagtgaaggtctcctgcaaggcttcnggaatccaccctcaccgacgtctatatgcacgtggttcgcgactacggcccctaggaccaagggcttgaagtggtacgtggggagttggaattcgaaacggtaacgaacgtggtcctcaacttaacaagtttanctacaacgtcgtacgttaacgtcgggtacggaccgggtacacggtacngaccgacggacgacgtcctactactacgaataccgnacctacgagtccgagaggcnggacgttcgagaacggtntacgacgaccggacggtacggtcttagttacttgttaccgttaggtaagcgaagtacggtacttacggtacttctttactacgttttacggg

SEQ ID NO: 351716 - DNA, 667 bp, Homo sapiens
  misc_feature: GZ8MTXP02F2LJ1.39.87.H10.1.454.CMB.2.raw
  modified_base (188)..(188): a, c, t, g, unknown or other
  misc_feature (188)..(188): n is a, c, g, or t
  modified_base (206)..(206): a, c, t, g, unknown or other
  misc_feature (206)..(206): n is a, c, g, or t
tcagtcgcactagtcacgaccggtgctcgatttagcagtactgcgttggggtttgggggggagtcagacccactcaggacacagcatggacatgagggtccccgctcagctcctggggcttctgctgctctggctcccaggtgccagatgtgccatccagttcgacccagtcctccactccctccctntctgcatcgtggtagganacagacgtccaacctactctacgttcggacccgggacaaggtcgagggactaaattaaaagtgtatttagcctaggtatacagacaacgaaaaccgaaggggaaaacctaccgtaaacggtcctagatactatgactcgccttacgtaggttacgggaagggttcggtaccagtacgagttccgacgggcggataggtagtacgttcggaggggtactacggtactttacccacttccacaaccctacgtacacccacgtcgtacggcggtacgtacgtaagttactttacgtaacttaactttaagttaactacgttaactaaactttaatttaacttcgttaactccgttactcgttaaccggttcgggaacgggaacggtacgtaaggtcgggaaatacgtaaacgaaaccgtagtcggtacgtagtaaccgtacacttacgtctctacttacttacc

SEQ ID NO: 351717 - DNA, 649 bp, Homo sapiens
  misc_feature: GZ8MTXP02IWE6W.39.87.H10.1.454.CMB.2.raw
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
tcagtcgcactagtcacgaccggtgctcgatttagcagtactgcgttgggtttggggatcacccagcaaccacatctgtcctctagagaatcccctgagagctccgttcctcaccatggactggacctggaggatcctcttcttggtggcagcagccacaggacgcccactcccaggtgcagctggtgcagtccgggactgaggtgaagagccgtgggcctcagtgaggtctctgcagcttngatccacctcaccgatctatangcacgtggtcgccgacnccggccccgtaggacgaagggtcttggaggtcggtagtggggatcggataccgaaacggtacgtacggtcggtcctacgaaacttaaagttacgtacgaccgtaaacgtaaggtaacgtttaccggaggggtacgtaacggggttccaaccgtagtacgacccgaacggggacctaaccgtactaacgtacaacgttaacacgtaccttaacgacggttacggaaacgttgacggacggaacggtactaggacttacgtacgtacggaaccgtaccgtacgggtaccttaggttacttagtttggacgtacggaacgtaggtataaggtacgttacttctacgtttacggtaggttcggggtttaagg

SEQ ID NO: 351718 - DNA, 618 bp, Homo sapiens
  misc_feature: GZ8MTXP02HMOEX.39.87.H10.1.454.CMB.2.raw
  modified_base (169)..(169): a, c, t, g, unknown or other
  misc_feature (169)..(169): n is a, c, g, or t
  modified_base (272)..(272): a, c, t, g, unknown or other
  misc_feature (272)..(272): n is a, c, g, or t
  modified_base (512)..(512): a, c, t, g, unknown or other
  misc_feature (512)..(512): n is a, c, g, or t
  modified_base (526)..(526): a, c, t, g, unknown or other
  misc_feature (526)..(526): n is a, c, g, or t
  modified_base (579)..(579): a, c, t, g, unknown or other
  misc_feature (579)..(579): n is a, c, g, or t
  modified_base (586)..(586): a, c, t, g, unknown or other
  misc_feature (586)..(586): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggancccactcccaggtgccagctggtgcaggtccgggactggaggtagaaagaacgccgtggggcctacagtggaaggttcctccgtgaccgaagggtccttacgnggaactccgaccctcaccgacgtctatactgctactggtgcgacgcggcccccgtaggaccgaaggtccttaggaggtgtacgtggggagtggactacggaaccggttaacgagttcggtactacgaaccttaaatttcacggtacaacgtacggttaacgtttacggaaggggtccgaagggtaccaccggtatacggacgtaaggacctaccgtcaatactaatacgacgacccttanacgttacgggaacngacgtgacgtacgagatagtacgacgacgtcgtacggtcttagttagtgtcgngacgagntacgtacgtacgtactacgtttacgtacgtgg

SEQ ID NO: 351719 - DNA, 632 bp, Homo sapiens
  misc_feature: GZ8MTXP02GAQ0D.39.87.H10.1.454.CMB.2.raw
  modified_base (368)..(368): a, c, t, g, unknown or other
  misc_feature (368)..(368): n is a, c, g, or t
tcagtcgcactagtcacgaccggtgctcgatttagcagtactgcgttgggtttgggggcatcacccagcaaccacatctgtcctctagagaatccccctgagagctccgttcctcaccatggactggacctggagatcctcttcttggtggcagcagccacaggacgcccactcccaggtgcagctggtgcgagtccgggactgaggtagaagaagccgtgggcctgagtgaaggtctccgtgcgaggcttcgtaggaactccaccctcacccgacgtactatagcgcctagtggttcgacgaccgacggccccgtaggaccgaagggtcttggaggtggagtggggatggatacgaaacggtaccgngtcggtacacataaaagttgtcgactaacgtagtaacgtttcggaaggtacgtagggtaccaaccgtacgtacgaaccggtacgggacctacgtccgtaactacgaaacttacgacgtaccctaagtacgtaacggtaagtaggacggacgtaaggtcgtacggagtacgtagacgaacgtaccgacggtacgtagttacgttagtcggtaggacgtagagtgtagtaacgttaccgttcgtacgtacgttaggtttaacgggg

SEQ ID NO: 351720 - DNA, 774 bp, Homo sapiens
  misc_feature: GZ8MTXP02IUJAG.39.87.H10.1.454.CMB.2.raw
  modified_base (379)..(379): a, c, t, g, unknown or other
  misc_feature (379)..(379): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcgaggtccgggactggaggtgaagagccgtggggcctagagtgaggtctcctgcaggtcttcaggactccaccctcaccgacgtctatatgctacgtggtgcgacgacggcccctaggacgaagggtcttggaggtggagtgggtatggactacgaacggtaacaggtgtacctacaactaaacttntgacacgagtacgtttgagggtacgaggtacacagtacgacgaggacaccgtacatacgaactacgaactaccgtaactaacgttacggaaacgttacggaacggaccgtaacggggtaccttacgggtaaagtaccgtttaacccgggtaaacggaaaaccccgggtaaacccggggttaacccccgggggtttacccccggttttaaacgggggtttaaaacccgttttttaaacgggggtttacccggggtttaacggggaaaacccgggggttttaacgggaaaaacggggtttaacgggtttaaacgggtttaaaacccgggttttaaaccccggttttacccggttttaaacccccgggtttttaaaacgggttttttaaacggggggg

SEQ ID NO: 351721 - DNA, 603 bp, Homo sapiens
  misc_feature: GZ8MTXP02GAVUF.39.87.H10.1.454.CMB.2.raw
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (369)..(369): a, c, t, g, unknown or other
  misc_feature (369)..(369): n is a, c, g, or t
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggagatcctcttcttggtgcagcagccacaggagcccactcccaggtgcagctggtgcagtccggactgagtgaagagcgtgggcctnagtgaggtctctgcaaggtctgnggaatccaccctcaccgacgtcatatgactacgtggttgacgacgacggcccctaggaacgaagggtcttggagtggagtgggatggaatcgaaaccggtacaggtagtcctacaacgtaaattgngtactaacgtaagtaacgtttcgaaacggggtcgtaacggggtaccaacgaagtacggaaccgtaggggtaacccaccggttaacacgtacgtaaattccgaacgtacctaacagttacgggaacctagggacgtaccgagtaccgtaggaacgtaactcggtacgaacgacgtacggtaccgtagttaattgtacgtacgngancgatacgacgtactacgttctaagttggg

SEQ ID NO: 351722 - DNA, 689 bp, Homo sapiens
  misc_feature: GZ8MTXP02HVDBX.39.87.H10.1.454.CMB.2.raw
  modified_base (337)..(337): a, c, t, g, unknown or other
  misc_feature (337)..(337): n is a, c, g, or t
tcagtcgcactagtcacgaccggtgctcgatttagcagtactgcgttgggtttgggggagcatcacccagcaaccacatctgtcctctagagaatccccctgagagctccgttcctcaccatggactggacctggaggatcctcttcttggtggcagcagccacaggacgcccactccccgaggtgcagcgtggtgcgagtccgggactgaggtgaaggagccgtggggacctcagtgaggtctccgtgcaggtcttcgaggatccaccctcaccgtacgtctatatgcactggtcgacgacgacggcccctaggaaccgaggtcgttggagtaggngtgggattggggaacctagaaaccggtaaaacgtcggtaggtaccttacaacctaaaatttgtagaccaaagtaacgggtaagttaccgaggggtaccacgggggttaacccacgtaacgacggaacggaaccgggtaacgacccgttaacaacgtaacctaaacgtaaccgtacgtaaccctaaagacgtaacggtaagtacggtaacgacggacgtacggtagaacggtaacgtacgtacgtaaccggtaacggtaaccggtacggtacggttaagtttacgttacggtacggtaggaagaagtacgtaacgttacgttacgtttacgtttacgtttaacggttaacggg

SEQ ID NO: 351723 - DNA, 685 bp, Homo sapiens
  misc_feature: GZ8MTXP02JNTPM.39.87.H10.1.454.CMB.2.raw
  modified_base (269)..(269): a, c, t, g, unknown or other
  misc_feature (269)..(269): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagccgtggggcctcagtgaaggtctcctgcaaggcttctggaatcgaccctcaccgngtctactatgcactggttgcgacacggcccctggaccgaaggtcttggaacgttggattggggaattggggacttacgaaccccggttaacgagtacggttacctacgtaagtaaaactttgtacggacaaacgaggtaaagttttccggagggtaccgtacgggggttacaacccgtagtacggaacccagggggtaaccaacggttcccaaggttaccaaaattacgaacgtacccttaaagaccgttagggaaaacccttgggaagtaccgaagggaaccggttcgaaaggaacgttcccgtagaaaccggtccggaaacgggccccgttagggtaaacttcgtttacggaccgttagggaagtaacggacgtacggtaaaggttccgttaacgtttcctaaaccgtttcggg

SEQ ID NO: 351724 - DNA, 548 bp, Homo sapiens
  misc_feature: GZ8MTXP01EQJ7P.13.63.F08.1.454.CMB.2.raw
  modified_base (512)..(512): a, c, t, g, unknown or other
  misc_feature (512)..(512): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagaagcctggggcctcagtgcaggtcgcctgcagggcctctggttacattttcgacaactttggcatctactgggtgcgacaggcccctggccacggccttgagtcgctggggtgatcagttgtacacggtgacacagactttgcacagtaagtttgagggtcagagtcaccctgacccaacagcacagtcccgacgaacacagcctacataggaactgaggaatctagacatctcgacgacaccggaccatactattactgtgacgagaaggtcggttttggggcgtcggactcgtcttgagttagtcgtgggccgnggggacaagtggtcaccgtcgttcttcgaagtcccg

SEQ ID NO: 351725 - DNA, 546 bp, Homo sapiens
  misc_feature: GZ8MTXP01DIJ4A.13.63.F08.1.454.CMB.2.raw
  modified_base (274)..(274): a, c, t, g, unknown or other
  misc_feature (274)..(274): n is a, c, g, or t
  modified_base (382)..(382): a, c, t, g, unknown or other
  misc_feature (382)..(382): n is a, c, g, or t
  modified_base (427)..(427): a, c, t, g, unknown or other
  misc_feature (427)..(427): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
  modified_base (535)..(535): a, c, t, g, unknown or other
  misc_feature (535)..(535): n is a, c, g, or t
tcagtcacgtactacacgaccggtgctcgatttagcgatcgtataaggggacccaaaaaccacacccctccttgggagaatcccgtagatcacagctccccaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggcatctactggggtncgacaggcccctggccacggccttgagtcgctggggtggatcagttgtacacggtgacacagactttgcacagaagtttgaggcagacgtccacctgaccacaagacncatccgacgaacacagcctacatgaactgaggaatctagacatcngacgacacgaccagtatattactgtgcgagaagggtacggttttggggcgtcggactccgtntgagtnttcgtggggtccaggggcaagtgtcgaaccgtctcgttcncgcctaacccg

SEQ ID NO: 351726 - DNA, 571 bp, Homo sapiens
  misc_feature: GZ8MTXP01BKLMW.13.63.F08.1.454.CMB.2.raw
  modified_base (528)..(528): a, c, t, g, unknown or other
  misc_feature (528)..(528): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttactattttcgactaactttggcatctactggggtgcgacaggcccctggccacggccttgagtcgcgtggggtgatcagttgtacaacggtgacacagactttgcacgaggtaagtttgagggcaggactcaccctgacccaacagcacatcccgacgaacacagcctacatggaactgaggaatctgacatactagacgacacggaccatatattactgtgcgaggtaaggtacgggttttggggcgtcggtactccgtcgttgtaggagtcggtcggggttaccgnggggacgaagtgggtctacccggtcttcgtcgaacggtccccg

SEQ ID NO: 351727 - DNA, 579 bp, Homo sapiens
  misc_feature: GZ8MTXP01DRT7Q.13.63.F08.1.454.CMB.2.raw
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgcctgcagggcctctggttactattttcgaactaacgtttggctatctacgtgggtgcgacaggcccctggccacggccttgagtcgcgtggggtgatcagttgtacaaggtgacanagtactttgcanagtagtttgaggcagacgtacacctgaccaacagaacacactccgacgaacacagccanatgaactgagatactgacanctgacgacacggacatatattactgtgcgaggtaacggtacgggttttgggcggcggtacgtccttcgttggagttacgtcggtcggggccggttaggggacgtaaaggtcggtaaccgtaccggttcttacgttccgcggtaaccccg

SEQ ID NO: 351728 - DNA, 553 bp, Homo sapiens
  misc_feature: GZ8MTXP01DZCY1.13.63.F08.1.454.CMB.2.raw
  modified_base (502)..(502): a, c, t, g, unknown or other
  misc_feature (502)..(502): n is a, c, g, or t
  modified_base (517)..(517): a, c, t, g, unknown or other
  misc_feature (517)..(517): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggctatctactggggtgcgacaggcccctggcccacggccttgagtcgcgtggggtggatcagttgttacaacggtgacacagactttgcacagaagtttgaggcagagtcaccctgaccaacagaacacatccgacgaacacagcctacatggaactgaggaatactgacatctcgacgacacggaccaatatattactgtgcgaggaaggtacggttttggggcgtcggtactcctcgttgngagtcgtggggccgnggggacaagtggtcaccgtcttacttcgaacgtccc

SEQ ID NO: 351729 - DNA, 536 bp, Homo sapiens
  misc_feature: GZ8MTXP01DKELJ.13.63.F08.1.454.CMB.2.raw
  modified_base (235)..(235): a, c, t, g, unknown or other
  misc_feature (235)..(235): n is a, c, g, or t
  modified_base (490)..(490): a, c, t, g, unknown or other
  misc_feature (490)..(490): n is a, c, g, or t
  modified_base (503)..(503): a, c, t, g, unknown or other
  misc_feature (503)..(503): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctntggttacattttcgacaactttggcatctactgggtgcgacaggcccctggcccacggccttgagtcgctggggtgatcagttgttacaacggtgacacagactttgcacagaagtttgaggcagagtcaccctgaccaacagcacatcccgacgaacacagccctacatggaactgaggaatactgacatctgacgacacggccatatattactgtgcgagaaggtacggttttggggcgcggctctcttgagngtcgtggggccgnggggactaagtggtcacgtcttcttcgcgtccc

SEQ ID NO: 351730 - DNA, 544 bp, Homo sapiens
  misc_feature: GZ8MTXP01BP47L.13.63.F08.1.454.CMB.2.raw
  modified_base (432)..(432): a, c, t, g, unknown or other
  misc_feature (432)..(432): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgagtaactttggcatctactgggtgcgacaggcccctggccacggccttgagtcgcgtggggtggatcagttgtacaacggtgacacagtactttgcacagaagtttgaggcagagtcaccctgaccaacagcacactccgacgaacacacgacctacataggaactgaggaataccgacatcngacgacacgccatatattactgtgcgagaggtacggtttgggcgcggactcctcttgagtattcgtgggcgaggggcagtggtcaaccgtctcttcaacgttccgtaacccg

SEQ ID NO: 351731 - DNA, 695 bp, Homo sapiens
  misc_feature: GZ8MTXP01CU2OP.13.63.F08.1.454.CMB.2.raw
tcagtcacgtactacacgaccggtgctcgatttagcgatcgtataaggggacccaaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgcctgcagggcctgtggttacattttcgactaactttggctatctactgggtgcgacacggcccctggcccacggccttgacgtcgcgtggggtgatcagttgtacgaacggtgacacgagtactttgacacgtagtaagtttggagggtcaacggtcggtaccacccgtgaacccaaacgagaaccacactcccggacgaaccacacgtaccctaactagtacggaacgtggaacggtaatacgtacgactacttacgacgaaccgtacgaccggacctaagttaacgttattaaccgtggttacgacggtaaggtaacgggggtttacgggttttcgggggaccgtaccgggtaccgttccgttcgttacggtacggttacgtaccgggtcgggggacccgttacggggggacctaagggttccgggtcctaacccggggttcttaccggtttaacaaccgtaaccccgg

SEQ ID NO: 351732 - DNA, 546 bp, Homo sapiens
  misc_feature: GZ8MTXP01BQJQ5.13.63.F08.1.454.CMB.2.raw
  modified_base (336)..(336): a, c, t, g, unknown or other
  misc_feature (336)..(336): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
  modified_base (460)..(460): a, c, t, g, unknown or other
  misc_feature (460)..(460): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcgagtgcgaggtcgcctgcagggccttcgtggttactattttcgactactttggcattctacgtgggtgcgacacggcccctggccacggcctgagtcgctggggtgatcagttgtacaacggtnacacagtactttgcacagagtttgaggtcagagtcacccgtgaccaacagcacactccgacgaacacncgaccanatagactgagagtactganatctacgacgacacggaccatatatacgtngcgaggtacggtacggttttgggcgcgtactctcgttgagngtcgngggttccgngggactaagtgctacgtcttctcgcgtcccc

SEQ ID NO: 351733 - DNA, 724 bp, Homo sapiens
  misc_feature: GZ8MTXP01C0QB1.13.63.F08.1.454.CMB.2.raw
  modified_base (284)..(284): a, c, t, g, unknown or other
  misc_feature (284)..(284): n is a, c, g, or t
  modified_base (323)..(323): a, c, t, g, unknown or other
  misc_feature (323)..(323): n is a, c, g, or t
  modified_base (429)..(429): a, c, t, g, unknown or other
  misc_feature (429)..(429): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcgaggtcgcctgcgacgggcctcgtggttactagttttcgaactaactttggctatctacgtggggtncgacacggcccctggcccacggcttgacgtcgcgtgggngatcgagttgtaacacggtgacacagtactttgacactagtaaagtttcgagggtacagtacgtcacccgtagaacccaacaagaacactacaccggaccgaaacncgaacgaccctacagtacggaactggaaagtaactcgtagaactacttcgagaacgacgaacccggacgtaaacttaattaaacgttaaccgtggtacgtaaccggtaagggtaaaacgggggttttacgggttttcgggggaccggtaccgggtaaaccgttccccgttaacggtttgggtaaacgttaaaccgggtttccggacggggggttaacccccgaaggggggaaacttaacgggtacggttccccgtaccggttacccggtttctttccggaaacccgttcccccgg

SEQ ID NO: 351734 - DNA, 664 bp, Homo sapiens
  misc_feature: GZ8MTXP01CN0PS.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagaagcctggggcctcagtgcaggtcgcctgcagggcctcgtggttactattttcgagtaactttggctatctacgtgggtgcgacacggcccctggccacggccttgagtcgcgtggggtggatcgagttgtacaacgggtgaacacagtactttgcacagtaagtttgagggtcacgagtcacccgtgaccctaaacagaacacatcccgacgaaacacacgaccctacataggaactggaagaacgtaccgaacataccgtagaaccgacacggaccacgttaagtaacttacgtagtaggacggtaaggtaaacgggttacggggtttttcgggggcggtaccggtaaccgttccttcgtttacggaggttaacgttccgggttacggggccggttaaggggaccgttaaggtcgggttacccgtaaccggtccttcgttaccgtaacgttccccgttaaccccgg

SEQ ID NO: 351735 - DNA, 547 bp, Homo sapiens
  misc_feature: GZ8MTXP01B51CB.13.63.F08.1.454.CMB.2.raw
  modified_base (502)..(502): a, c, t, g, unknown or other
  misc_feature (502)..(502): n is a, c, g, or t
  modified_base (513)..(513): a, c, t, g, unknown or other
  misc_feature (513)..(513): n is a, c, g, or t
tcagtcacgtactacacgaccggtgctcgatttagcgatcgtataaggggacccaaaaaccacaccccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgcctgcagggcctctggttactattttcgactaactttggcatctacgtggggtgcgacaggcccctggccacggccttgagtcgcgtggggtgatcagttgtacaggtgacacagactttgcacgagaagtttgagggcagagtcaccgtgaccaacagcacactcccgacgaaaccacacgaccctacataggaactgaggaatactgacatcacgacgacgacgccatatatactgtgcgagaaggtacggtttgggcgcggactctcgttgtagntcgtgggccgngggactaagtggtcacgtcgttcttcgcgtcccg

SEQ ID NO: 351736 - DNA, 628 bp, Homo sapiens
  misc_feature: GZ8MTXP01AHUZ7.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaacgtttggcattctacgtggggtgcgacaggcccctggccacggcctgagtcgcgtggggtgatcagttgtacaacggtgacacagtactttgacacgagtaagtttgagggcagagtcaccctgacccaacacgaacacacgtccgacgaacacacgaccctacagtaggaactgaaggaatcgtagacatcgtacgacgacgaccggactatatattacgtgtgacgtaggtaacgggttacgggttttcgggggacggtcgggtccgttccgtcgttaggacggttacgtccggtcggggaccggttacgggggaacctaaggttcgggtaacccgtcccggttaccgttccgttccgaaccgtaacccccg

SEQ ID NO: 351737 - DNA, 721 bp, Homo sapiens
  misc_feature: GZ8MTXP01BPXE8.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagagccgtggggcctcgagtgcgaggtcgcctgcgagggtcctcgtggttaactatttttcgaactaacgtttggctattctacgtgggtcgcgacacggccccgtggcccacggccttggagtcgcgtggggtggatcgtagttgttaacacggtgacacgagtactttgctacgagtaagtttggaggacgacgagttaccacccgtagaacccaaacaacgaacacacgtaccccgacgaaaccgaacacgaccctaacagttaggaaaccgtgaaggtaataccgtagaccatcgacgaacgaacgacccggaccgaattaacgttaacttaccgttagtcggacggtaagggtaaacggggtttaccggggtttttcgggggaccggtccgggttaaccgtttcccgttaccgtttagggaacggttacggttccgggtacggggttaccgggacggggttaactaaacggttcggtaaccgttacccgggttccttcgtttaaccgaacggtaacccccg

SEQ ID NO: 351738 - DNA, 691 bp, Homo sapiens
  misc_feature: GZ8MTXP01ARPY3.13.63.F08.1.454.CMB.2.raw
  modified_base (332)..(332): a, c, t, g, unknown or other
  misc_feature (332)..(332): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgcctgcagggcctcgtggttactattttcgactactttggctatctacgtgggtgcgacacggcccctggccacggcctgagtcgcgtgggtgatcagttgtacacggtnacacagtactttgcacagtaagttgaggcacgagtcacccgtgaccaacagaacacactccgacgaacacagacctacataggaactagaaggaatacgtgactacgtctacgaacgaacgaccgggaccgtaattaactaattaccgttagtacgaccggaagggtaaacggggttaccgggggtttttcgggggaccggtaccgggtaaccgttcccgttccggttaggtaaacggttacggttaccggggtacgggggacccggttaaacggggggttaacccgttaaagggtccggggttaaccgtaaccccggggttccttacccgttttaaccgaaccgggttaaccccccgg

SEQ ID NO: 351739 - DNA, 708 bp, Homo sapiens
  misc_feature: GZ8MTXP01BVA4P.13.63.F08.1.454.CMB.2.raw
  modified_base (383)..(383): a, c, t, g, unknown or other
  misc_feature (383)..(383): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcgaggtcgcctgcagggcctcgttggttactattttcgactaacgttttggactattctacgtggggtcgacgacgacggcccctggcccgacggtccttgagtcgcgtggggtgatgagttgttacgaacggtgacacagtactttgcacgagtagttgaggcagntcaccgtgaccaacacgcacactccgacgaacacgacncctanagtacggaactggaagtatacgtcgaacncgtacgtagaaccgtaacgacccggacgtaacttaagttactttacgttaggtacggacggtaacggggttaaaggggtttcgggggtttttcgggggaccggtaccgggttaccgttccccggttaacggtttggtaaacggttcggttccggggttacgggggaaccggttacgggggttaaccgttaaaccggttcgggtaacccgttaccccggttaccgttaccgttcccgaacggtttaaccccccg

SEQ ID NO: 351740 - DNA, 653 bp, Homo sapiens
  misc_feature: GZ8MTXP01EANJ2.13.63.F08.1.454.CMB.2.raw
  modified_base (279)..(279): a, c, t, g, unknown or other
  misc_feature (279)..(279): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcgaggtgcaggtcgcctgcgagggcctcgtggttactatttcgactaatttggctatctacgtgggtncgacaggcccctggccacggcttgagtcgcgtggggtgatgagttgtacgaggtnacanagtatagacagagtagttgagnacgactcaccngaccaatacgcactacncccggacaacacacgtacctacgagtacggaactaggaaagtactacgtactacaacgttcgacgaaaccgacgaacccggaccttaaagtactttaaacgttacgtggttacgaaccggtaagggttaaacggggttttcgggggtttaggggacccgtaccggtaccgttccttgttaggtacgttacggtcgggttaacggggacggttaggaaccgttggtacgtcccgtaacgttcttaccgtcgttaaccgtaaccccg

SEQ ID NO: 351741 - DNA, 737 bp, Homo sapiens
  misc_feature: GZ8MTXP01C4JXB.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagccgtggggcctcagtgcaggtcgcctgcgagggcctcgtggttactattttcgactaactttggcatctacgtgggtgcgacacggcccctggccacggcctgacgtcggcgtggggtggatcgagttgttaacgacggtgacacgagtactttgacaacgagtaagttgaggacaggagtcacccgtgacccaaacgagaacacactcccgacaaccacacgaccctaacagttaacggaactaggaacgggaaacttactacggaactaacgtaccgtacgaaccgaaccgaccgggaaccctaagtaaacgtttaagtttaaccgtaggtacgtacggaagggttaaacggggtttccgggggtttttagggggacccgtaccggggttaacttcccgtttacgttgggtaaccggttgtttacccgggtaggggggttacccgttaaaggggggttaaccgtaacgggttacggggtttaacccgtaacccgggtttccttacccgggtttcccgaaccggtaaccccccgg

SEQ ID NO: 351742 - DNA, 560 bp, Homo sapiens
  misc_feature: GZ8MTXP01AT77I.13.63.F08.1.454.CMB.2.raw
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (470)..(470): a, c, t, g, unknown or other
  misc_feature (470)..(470): n is a, c, g, or t
  modified_base (511)..(511): a, c, t, g, unknown or other
  misc_feature (511)..(511): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtgggcctcagtgcaggtcgcctgcgagggcctctggttactattttcgactatttggctatctacgtgggtgcgacacggcccctggcccacggccttgagtcgcgtggggtgatcagttgtacaacggtnacanagactttgacacagaagtttgaggcagatcaccctgaccaacagaacacacgtccgaccgaacacacgaccctacagtaggaactagaaggaatcgtagacatctagacgacacggactaatatattactgngacgagagggtacggtttgggcgtcggtctctcgttgacgngtcggtcggcgagggactaagtggtcgacgtcgttcttcgcgtaacccg

SEQ ID NO: 351743 - DNA, 764 bp, Homo sapiens
  misc_feature: GZ8MTXP01CB2K6.13.63.F08.1.454.CMB.2.raw
tcagtcacgtactacacgaccggtgctcgatttagcgatcgtataaggggacccaaaaaaccacacccctccttgggagaatcccgtagatcacagctcctcaccatggactggacctggagcattccttttcttggtggcagcggcaacaggtgtccaccctgaggttcagttggttcagtctggaggagggtgaagagccgtgggcctcgagtgcgaggtcgcctgcgacgggtcctcgttggttactacttttcgaactaactttggactatcgtacgtgggtgcgacgacggccctggcccacggtctgagtcgcgtggggtgatcgtagttcgtaacgacggtgaacacgagtactttgacacgtagtacgttggaggactacgacgtacacccgtacgacccaaacgaacgaaccactaaccgtccgacgaaaccacgacgaccctactagtacggaacgtaggaagtaactacgtacgaactacgtaccgacggaaaccgtacgtaacccggtacgtaaatttacgtttaacgttaaccgtggttaacggaccgggttaaagggtaaacgggggtttccgggggttttacgggggacccggttaccgggtaacccgtttcccggttaggttacgggtaacgttacggtaccggggttaccgggggttacccgggttaaggggttaaaccgttaacgggttccggtaacccggttcccggttccgttaccgttaacccggaacccgttaaccccccgg

SEQ ID NO: 351744 - DNA, 572 bp, Homo sapiens
  misc_feature: GZ8MTXP01A3HBQ.13.63.F08.1.454.CMB.2.raw
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
  modified_base (396)..(396): a, c, t, g, unknown or other
  misc_feature (396)..(396): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagaagccgtggggcctcagtgcaggtcgcctgcagggcctcgtggttactattttcgactaactttggcatctacgtgggtgcgacacggcccctggccacggccttgacgtcgctggggtgntcagttgtacaacggtgacanagactttgcacagaagtttgaggcagagtcacctgaccaacagcacatccgacgaacncacgcctacatagactgagatctgactatcgtagacgacacggacaatatacttactgtgcgagtaacggtcgggtttggggcgtcggcctcgtcttagggagttacgtcggtggggaccccggaggggactaacggttcggtaactacccggtcgttacgttccgcgtaaccccg

SEQ ID NO: 351745 - DNA, 675 bp, Homo sapiens
  misc_feature: GZ8MTXP01B6413.13.63.F08.1.454.CMB.2.raw
  modified_base (457)..(457): a, c, t, g, unknown or other
  misc_feature (457)..(457): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagaagccgtggggcctcaggtgcgaggtccgcctgcgagggtcctcgtggttaactattttcgactaactttggctatctacgtgggtgcgacgacggcccctggccacggccttgagtcgcgtgggtgatcgagttgtaacgaggtgaacagagtactttgacagagtagttggaggcaagtcgtaccaccgtcgaccaaacgacgaacacgtacgtacccgacgaacaacgcgaccctaacagtacgaacgtaggaagtanacgtagtacatacgacgaaccgaccgtaccgacctaaattacgttaattaccgtgtacgtacgtaagggtaaacgggtttcggggttttacggggccgtccggtaaccgtttccgtagtttacggaggttacgttccgggtacgggggacccgttaggggaaaccgttaacggtcggttaacccgtcgttaccgttccgttccgaaccgtaacccccg

SEQ ID NO: 351746 - DNA, 634 bp, Homo sapiens
  misc_feature: GZ8MTXP01B5WBN.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggagggtgaagaagccgtgggcctcgagtgcgaggtcgcctgcagggcctcgtggttactattttcgaactaacgtttggctatctacgtgggtgcgacacggccccgtggcccacggtccttgagtccgcgtggggtgatcgtagttgttaacgaacggtgaacacgagtactttgacgaagtagtaagtttggagggtacaaggacgtcaacacgtacgaaacccaacgaacgaccaaacacgtacccgaacgaaaccacacgacctaacagtacggaacgtagaaggaatctagacagtcacgaacgacgacgggactataataacttatgtacgacgaaggtaggttacgggtttgggcgtcggtaactcgttcgttagagtacgtcggttacgggccgaagggtaaccgtagtcggtaccgtacgttcgtccgttcgaacccg

SEQ ID NO: 351747 - DNA, 801 bp, Homo sapiens
  misc_feature: GZ8MTXP01B6E83.13.63.F08.1.454.CMB.2.raw
  modified_base (191)..(191): a, c, t, g, unknown or other
  misc_feature (191)..(191): n is a, c, g, or t
  modified_base (241)..(241): a, c, t, g, unknown or other
  misc_feature (241)..(241): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccacctgaggttcagttgttcagtctggaggagggtnaagagccgtggggcctcagtgcgaggtcgcctgcgagggcctctggtatnttttacgactaactttggctagttctacgtgggtgacgcacggcccgtaggcccacggtccttgacggtcgcgtaggggtagacttacgtaagtttcggtaacaacgggggtcaacgtacccgtagtaccgtttagcctaaacgtaaggttaaggtttaggaacgggggtaccaaggtaacgggtcctaaaccccgtcggaaaccctaaaacgaacccgggaactaaacccgacgttacccgggaaccaaacggacccgttaacgaaccctttaaccgagtttaacgggaaaacgttccggtaaaggaaccttaacccgggttaaacgaacgtacgtacgaacgtaaaccacggaaccggttaacgttaattaaacgttagttaacggttaggtcggtaacgtaaggggtaaaccggtttacgggggttccggaccggtcggttaaccgtcgttacggttaaggtacgttaccgtacgggtacggggttaccggacggttaaacgtaacggttaccggtaacccgttaccgttccgttccgtaacccggttaacgtcccg

SEQ ID NO: 351748 - DNA, 546 bp, Homo sapiens
  misc_feature: GZ8MTXP02JEOU1.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgcgtggggtggatcagttgttacaacggtgacacagactttgcacagaagtttgagggcagagtcaccctgaccacagaccacatcccgacgaacacacgcctacatggaactagaggaatctgacatctagacgacgacggcatatattactgtgcgaggaaggtacgggttttggggcgcggactccgtcttgacgatcgtcggggccaggggacaagtcggtcaccgtctcttcacgtcccg

SEQ ID NO: 351749 - DNA, 577 bp, Homo sapiens
  misc_feature: GZ8MTXP02HTC5N.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttagactaactttggctatctactgggtgcgacaggcccctggcccacggccttgagtcgctggggtgatcagttgttacaacggtgacacagactttgcacagaagtttgagggcagagtcaccctgaccacagaccacatccgacgaaacacagccctacatggaactgaggaatctgacatctgacgacacggccatatattactgtgcgagaaggtacgggttttaggggcggtcggtacttccgttacgttaggacgtagttcgtcgggggccgaagggggacctaaagtcggtaccgtaccgtcgttcctttacgacggtaccccg

SEQ ID NO: 351750 - DNA, 551 bp, Homo sapiens
  misc_feature: GZ8MTXP02FP1W5.13.63.F08.1.454.CMB.2.raw
tcagtcacgtactacacgaccggtgctcgatttagcgatcgtataaggggacccaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacacggtgacacagactttgcacagtaaagtttgagggcagagtcaccctgaccacagaccacatccgacgaacacagcctacatggaactgaggaatctgacatctgacgacacggccatatattactgtgacgagtaagggtacggttttggggcgcggtactcctcgttgacgatcgtcggggccgaggggacaagtcggtacaccggtctccgttcgacgtaccccg

SEQ ID NO: 351751 - DNA, 551 bp, Homo sapiens
  misc_feature: GZ8MTXP02GD4DB.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgcctgcagggcctctggttacattttcgactaactttggctatctacgtgggtgcgacaggcccctggccacggccttgagtcgcgtggggtggatcagttgttacaacggtgacacagactttgcacagaagttgagggcagagtcacctgaccacagacacatccgacgaacacagcctacatggaactgaggaatcagacatctagacgacacggccaatatattactgtgcgagaaggtacgggtttggggacgcggtactccgtcgttgacgtagtcgtcgggccgagggacaagtcggtacaccgtacgtcttcgacgtcccg

SEQ ID NO: 351752 - DNA, 539 bp, Homo sapiens
  misc_feature: GZ8MTXP02JVHIS.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactggggtgcgacaggcccctggccacggccttgagtcgctggggtggatcagttgttacaacggtgacacagactttgcacagaagttgaggcagagtcaccctgaccacagcacatcccgagaacacagccctacataggaactgagaatctgacatctgacgacacggccatatattactgtgcgagaaggtacgggtttggggcgtcggactccgtcgttgacgagtcgtcggggccgaggggacaagtggtcaccggtctctcgagtccc

SEQ ID NO: 351753 - DNA, 551 bp, Homo sapiens
  misc_feature: GZ8MTXP02JERC8.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgagtaactttggctatctacgtgggtgcgacaggcccctggcccacggccttgagtcgctggggtgatcagttgttacaacggtgacacagtactttgcacagagtttgaggcagagtcaccctgaccacagcacactccgacgaacacagaccctacagtggaactgaggaataccgacatctagacacgacggccatatattactgtgcgagaggtacggtttgggcgtcgactccgtcgttgagacgtcgtacggggcgacggggactaaggtgtcgaccgtctcgttcacgcctacccg

SEQ ID NO: 351754 - DNA, 561 bp, Homo sapiens
  misc_feature: GZ8MTXP02IE4E1.13.63.F08.1.454.CMB.2.raw
  modified_base (224)..(224): a, c, t, g, unknown or other
  misc_feature (224)..(224): n is a, c, g, or t
tcagtcacgtactacacgaccggtgctcgatttagcgatcgtataaggggacccaaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcncctgcagggcctctggttactattttcgactaactttggcatctacgtggggtgcgacacggccctggccacggccttgagtcgcgtggggtgatcagttgtacacggtgacacagtactttgcacagaagtttgaggcagagtcacctgaccacagcacatccgacgaacacagccacatacggaactgaaggatctagacatcagacgacgacgaccatatatactgtgacgtaggtaggtacgggttttgggcgtcggtactcgtacgttggacgtacgtcggtcgggaccgagggacgtaagtcggtacgaccgttctccgttcacgtccccg

SEQ ID NO: 351755 - DNA, 664 bp, Homo sapiens
  misc_feature: GZ8MTXP02IFM8E.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagagccgtggggcctcagtgcaggtcgcctgcagggcctctggttactattttcgagtaactttggcattctacgtggggtgcgacacggcccctggcccacggccttggacgtcgcgtggggtgatcagttgttacacggtgacacagtactttgcacagtaagttgaggcagagtcacctgaaccacacgacacatcccgacgaaccacacgtaccctaacataggaaactaggaacggaaactaccggaactactacacgacgaacgaccggacctaaataacttattacgttaggtagaccggaaggtaaacggggttacggggtttttgggggcgtccggggtaccttcccgttacgttggagtaacgtttccggggtacgggggtaccggaacgggggtaacaacggttaacgggttacccgtaaccgttccgttaccgttaccgtaccgtaccccgtacccg

SEQ ID NO: 351756 - DNA, 757 bp, Homo sapiens
  misc_feature: GZ8MTXP02GY2US.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggctatctactgggtgcgacaggcccctggcccacggccttgacgtcgcgtggggtgatcgagttgttacacggtgacacgagtactttgcacgtagaacgtttggaaggtcagagtcaccctgaccacagacacatacccgacgaaccacgtacgaccctaacagtacggaaacgtagaagggtaaacttcgtacgaacgaactttaccgtacggaaacccgtaaaccgaacccggggaaccccgttaaagttaaacctttaaagtttaacccgttagggtacggtaaccgggtaaagggtaaacgggggtttaaacgggggttttttaccgggggcccggtaaccgggggtaaccctttccccggttaccggtttacggaaggttaaaccgtttccggggttaaccggggggtacccgtaaaggggggaacaaaacgggtttccggggtaccgtaaacccggtttccttaaccgtttcccgacggtttaaccccccg

SEQ ID NO: 351757 - DNA, 616 bp, Homo sapiens
  misc_feature: GZ8MTXP02FQUUP.13.63.F08.1.454.CMB.2.raw
  modified_base (377)..(377): a, c, t, g, unknown or other
  misc_feature (377)..(377): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgcctgcagggcctctggttacattttcgactaactttggcatctactggggtgcgacaggcccctggccacggccttgagtcgcgtggggtgatcagttgttacaacggtgacacagactttgcacagtaagttgaggcagagtcacctgaccanagacacatccgacgaacacagcctacatagaactagaggaatctagacatctagaccgaacgacggaccaatactaattacgtgtacgacggaaggtaacgggttaacgggttttggggaccgtcgggtaaccttccgttacgtttaggagtaacgttcggttacgggggacccgaagggggaacctaaaggttcggtaccgtaacccggttccttaccgtttaccgacggtacccccg

SEQ ID NO: 351758 - DNA, 676 bp, Homo sapiens
  misc_feature: GZ8MTXP02IMZUE.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgcctgcagggcctctggttacatttttcgagtactttggcatctacgtggggtgcgacacggcccctggccacggccttgagtcgcgtggggtggatcgagttgttacacggtgacacagactttgcacagaagtttgaggcagagtcaccctgaccacagaccacactcccgacgaaaccacacgccctacagtaggaacctggaacggaactacccggactagtaccgtacgaccgaaccgaccggaccctaagttaacttaatttaaccgtggttaggaccggtaagggtaaacgggggtttacgggggtttttacgggggaccggtccgggtaaccttcccgttcgttacggtaggtacgttcgggtacgggggacccgaagggggaacctaaaggttcggtaccgtaacccggttcttaccgtttaccgaccggtaccctaacccccgg

SEQ ID NO: 351759 - DNA, 657 bp, Homo sapiens
  misc_feature: GZ8MTXP02GAUPS.13.63.F08.1.454.CMB.2.raw
  modified_base (277)..(277): a, c, t, g, unknown or other
  misc_feature (277)..(277): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctcgtggttacattttcgactaactttggctatctacgtggggtncgacaggcccctggccacggccttgagtcgcgtggggtgatcagttgttacacggtgacacagtactttgcacagtaagttgaggcagagtccaccctgaccacagaccacacgtccgacgaacacacgcctaacagtacgaaactggaacggtaaatccgtagaacattacgagaaccgaccgaaccggacctaagttaactactttaacgtgttacgaccggaagggtaaacggggtttacgggttttacgggggccggtacgggtaccttccgttcgtttacgggaagtacgttccgggtacgggggacccggtaagggggtaaccctaaaggtcggtaccgtacccgttcgtaccgtttaccgaaccgttcccccg

SEQ ID NO: 351760 - DNA, 566 bp, Homo sapiens
  misc_feature: GZ8MTXP02H6JK8.13.63.F08.1.454.CMB.2.raw
  modified_base (320)..(320): a, c, t, g, unknown or other
  misc_feature (320)..(320): n is a, c, g, or t
  modified_base (413)..(413): a, c, t, g, unknown or other
  misc_feature (413)..(413): n is a, c, g, or t
  modified_base (467)..(467): a, c, t, g, unknown or other
  misc_feature (467)..(467): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgcctgcagggcctctggttacatttttcgactaactttggcattctacgtggggtgcgacaggcccctggcccacggccttgagtcgcgtggggtggntcagttgttacgaacggtgacacagactttgcacagaagtttgaggcagagtccacctgaccacagaccacatcccgacgaacacagccacanagactagaggaatctgacatcgtagacgacaccggaccattatattactgtcgngagtaagggtacggttttggggcgtcgtcgtacctcttggagtacgtcgtcgggccgagggacgaagtcgtacgtaccgttcgtcttcgacgtaccccg

SEQ ID NO: 351761 - DNA, 692 bp, Homo sapiens
  misc_feature: GZ8MTXP02J4SME.13.63.F08.1.454.CMB.2.raw
  modified_base (218)..(218): a, c, t, g, unknown or other
  misc_feature (218)..(218): n is a, c, g, or t
tcagtcacgtactacacgaccggtgctcgatttagcgatcgtataaggggacccaaaaaccacacccctccttgggagaatccgtagatcacagctcctcaccatggactggacctggagcatcctttctggtggcagcggcaacaggtgtccaccctgaggttcagttggttcagtctggaggagggtgaagaagcctggggcctcagtgcaggtcncctgcagggcctctggttacatttacgacaacttgtcgatctactggtggtcgaccacggcccgtcggccgacgccgttcgtagtcgcgtgggtcggtagtctagttcgtttaacgtacggtacgacgacaagactattcacgtacgaaaggttacggttaggtacggaccgacgtacgtccaacccgtcgaacccacgacgtaaccaactccgaccgaccgaccgaaccgaaccgaaccgtaccgtaaccgtacgtacggtaacggtaacgtaaggtaacggttaactacgtacgtacgtacgttacgtaaccgaacccggaccggtaccgtactacttacttacgttacgtacgttaggtaacgggttacggtacggggttacggttacgggtacgttcggtcgtcgtcggtacgtccgtcgtcgtacggtaacgtacggtacggtacgtacggtcgtacgtacgttaccgg

SEQ ID NO: 351762 - DNA, 558 bp, Homo sapiens
  misc_feature: GZ8MTXP02F36SG.13.63.F08.1.454.CMB.2.raw
  modified_base (332)..(332): a, c, t, g, unknown or other
  misc_feature (332)..(332): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggcatctactggggtgcgacaggcccctggcccacggccttgagtcgcgtggggtgatcagttgttacaaggtnacacagactttgcacagtaagttgaggcagagtcacctgaccacagacacatccgacgaacacagcctacatacggaactgaagaatcgagtacatctagacgacacggaccatattattactgtagcggaagaacgggttacgggttttggggcgcggtactccgtcgttgacgagtcgtacggggccaggggaccaagtcgtacaccgtctcgtcacgtacccg

SEQ ID NO: 351763 - DNA, 524 bp, Homo sapiens
  misc_feature: GZ8MTXP02FJP9U.13.63.F08.1.454.CMB.2.raw
  modified_base (365)..(365): a, c, t, g, unknown or other
  misc_feature (365)..(365): n is a, c, g, or t
tcagtcacgtactacacgaccggtgctcgattagcgatcgtataaggggacccaaaccacacccctccttgggagaatcccgtagatcacagctcctcaccatggactggacctggagcatccttctggtggcagcggcaacaggtgtccaccctgaggttcagttggttcagtctggaggagggtgaagaagcctgggcctcagtgcagtcgcctgcaggcctctggttacatttcgacaacttggcatctactgggtgcgacaggcccctggccacggccttgagtcgctgggtgatcagtgtacacggtgacacagacttgcacagtaagttgagggcagacgtcaccctgacccacagacncatccgcgaacacagcctacatggaaactgagaatctgacatcagacgacacggtccatatagtactgtgcgagaaaggtcggtttaggggcgcggactccgtcttgacgactcgtgggacccaggggtaccaagtggtaccaccgtctctccacgccg

SEQ ID NO: 351764 - DNA, 613 bp, Homo sapiens
  misc_feature: GZ8MTXP02ICO2W.13.63.F08.1.454.CMB.2.raw
  modified_base (306)..(306): a, c, t, g, unknown or other
  misc_feature (306)..(306): n is a, c, g, or t
  modified_base (335)..(335): a, c, t, g, unknown or other
  misc_feature (335)..(335): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggcatctacgtgggtgcgacaggcccctggccacggccttgagtcgcnggggtggatcagttgttacacggtgacanagactttgcacagaagtttgaggcagagtcaccctgaccacagcacatcccgacaacacagcctacatgaactgaggaatctagactagtctagacgacaccggccatatattaacgtgttaggacgaggaagggttacgggtttttagggggccggtacggggaccttccgttccgttggacgtaacgttcggttcgggggacccggaagggggtaccgtaaacggtacgggttccgtaacccggttccgtttccctttaccgtaccgttacccccg

SEQ ID NO: 351765 - DNA, 668 bp, Homo sapiens
  misc_feature: GZ8MTXP02FOZHZ.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtgatcagttgttacaacggtgacacagtactttgacacagtaagtttgaggcagagtcacctgaccacagcacatccgacgaacacacgcctaacatacggaactaggaagaatactacgaacatccgtagaaccgaaacgaccggaccctaattaacttaactttaacgtagtacggacggtaaagggtaaacgggggtttacggggtttttagggggaccggtaccgggtaaccgttcccgtaccgtttacggtaaggtaacgttccgggttacgggggaccccggaagggggtaaccgtaaaaggttcggggtacccgtaacccggttaccgtttccgtttaccgacggtacccccg

SEQ ID NO: 351766 - DNA, 575 bp, Homo sapiens
  misc_feature: GZ8MTXP02FGK1V.13.63.F08.1.454.CMB.2.raw
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaacttttggcatctactggggtgcgacaggcccctggccacggccttgagtcgctggggtggatcagttgtacacggtnacacngactttgcacagaagttgaggcagagtcacctgaccacagacacatcgcgaacacagcctacatagaactgagaatctagacaatctagacgacacggaccatatattactgtcgacggaaggtaaggttacgggttttggggcggtacgggtaccttaccgtcgtttagagtaacttcggtcgggggacccgagggggaaccaaagtcggtaccgtaccgtcgtcttacgacgtaccc

SEQ ID NO: 351767 - DNA, 673 bp, Homo sapiens
  misc_feature: GZ8MTXP02ILMTL.13.63.F08.1.454.CMB.2.raw
  modified_base (342)..(342): a, c, t, g, unknown or other
  misc_feature (342)..(342): n is a, c, g, or t
  modified_base (386)..(386): a, c, t, g, unknown or other
  misc_feature (386)..(386): n is a, c, g, or t
tcagtcacgtactacacgaccggtgctcgatttagcgatcgtataaggggacccaaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttgctatctacgtgggtgcgacacggcccctggcccacggccttgagtcgcgtggggtggatcgagttgttaacgacggtgacanagtactttgacacaggtaagtttgaggcagtacgtccaccgtanaccgacacgacacacgtccgaccgaacacacgacctacagtaggaactggaacgaatctaagactacttacgacgaacgaccgaaccggaccaattaattacgtttacgtaggttcggaaccggtaagggttaacgggtttacgggggtttttggggaccggtacgggttaacccttcgtttccgttaggacgggttacgtaaccggggttcgggggaacccggtaaggggaacgtaacggttcggtaacccgtccgtttaccgtccgtttacgacgttaacccccg

SEQ ID NO: 351768 - DNA, 670 bp, Homo sapiens
  misc_feature: GZ8MTXP02FP2XG.13.63.F08.1.454.CMB.2.raw
  modified_base (345)..(345): a, c, t, g, unknown or other
  misc_feature (345)..(345): n is a, c, g, or t
  modified_base (452)..(452): a, c, t, g, unknown or other
  misc_feature (452)..(452): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtagaagaagccgtggggcctcagtgcaggtcgcctgcgagggcctcgttggttactattttcgactaacgtttggctatctacgtgggtcgcgacacggcccctggccacggcctggacgtcgcgtggggtgatcagttgtacacggtgacanagtactttgcacgagtaagttggaggcagagtccacctagaccacagacacgactccgacgtaaccacgacgacctaacagtacggaactaggaaacggaacttacncgaactactcgtacgaacgaaccgaccggacctaagtaacttaacgtttactacggtacgtacggaaaggtaacggggtttaacggggttttcgggaccggtccggtaacctccggttacgttgggaacgttaggtccggtacgggggtaccgtaagggggaacctaaggtccggggtaactacccgggttcctttacgtaccgtaacgtaacccccg

SEQ ID NO: 351769 - DNA, 701 bp, Homo sapiens
  misc_feature: GZ8MTXP02FHODU.13.63.F08.1.454.CMB.2.raw
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtcgtggaggaggggtgaagaagccgtggggcctcagtgaaggtcgcctgcagggcctntggttactnttttcgactaacgtttgcatctacgtgggtgcgacgacggccctggccaccggccttggagtcggcgtggggtcggtatcgtaggtttcgttacgaacggttagaccgtactaagtactttcgactaacgaaggtaaagtttggagggcgagcgtaccaccgtacgaccacacgacncactccgacgaacacncactacagtagaaccgtagaagtaatcgtagaactactacgtacgaacggaccgaaccggtacctaaagttaacgttactttaaccgtaggtagaaccggtaagggtaaacggggtttacgggggtttttcgggggacccggtacggtaacccgttcccgttacggtttacggtacggtacgtccgggttacggggaccggtaacgggacgtaacggtcggtacctaccgtaccgttccttacgaccgtaccgtaaccccgg

SEQ ID NO: 351770 - DNA, 551 bp, Homo sapiens
  misc_feature: GZ8MTXP02FWDK2.13.63.F08.1.454.CMB.2.raw
  modified_base (213)..(213): a, c, t, g, unknown or other
  misc_feature (213)..(213): n is a, c, g, or t
  modified_base (425)..(425): a, c, t, g, unknown or other
  misc_feature (425)..(425): n is a, c, g, or t
  modified_base (456)..(456): a, c, t, g, unknown or other
  misc_feature (456)..(456): n is a, c, g, or t
  modified_base (542)..(542): a, c, t, g, unknown or other
  misc_feature (542)..(542): n is a, c, g, or t
tcagtcacgtactacacgaccggtgctcgatttagcgatcgtataaggggacccaaaaacccacaccccctccttgggagaatcccgtagatcacagctcctcaccatggactggacctggagcatccttttcttggtggcagcggcaacaggtgtccaccctgaggttcagttggttcagtctggaggaggggtgaagaagcctggggtctnagtgcaggtcgcctgcagggcctctggttacattttcgactaactttggcatctactggggtgcgacaggcccctggccacggccttgagtcgctggggtggatcagttgttacaacggtgacacagactttgcacagtaagtttgagggcagagtcacctgaccacagacacatccgacgaacacagcctaacatggaactggaggaatcngacatctagacgacaccggccatatattacngtgcgagaagggtcggtttaggggcgcgactctcgttgagagtcgtcggggccgaggggacaagtggtaccaccggttctcttacncgtaccccg

SEQ ID NO: 351771 - DNA, 717 bp, Homo sapiens
  misc_feature: GZ8MTXP02IVQMV.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcgagtgcaggtcgcctgcagggcctctggttactattttcgactaactttggcatctacgtgggtgcgacgacggcccctggccacggccttgagtcgcgtggggtggatcgtagttgttacacggtgacacagtactttgctagagtaagtttgaggcagagtccacccgtgaccacgagacacactcccgacgaaccacgacgtccctacagtacggaacgtagaacggtaatcgtacggtaacacgttacgtacggaaccgaaaccggaacccgggtaccctaagttaaactttaaccgtttacgtacggtaccggtaggtaaacggggttaacgggggtttaaccgggggtttttcgggggaccggtccggggttaacccgtttacccgttaccggtttacggtaaggttaccggttacgggttaccgggggtaccggtagggggtaaaccgtaaggtaccggttaccgtaccggttccgtccgttaccgaccgtacccccg

SEQ ID NO: 351772 - DNA, 663 bp, Homo sapiens
  misc_feature: GZ8MTXP02FQK56.13.63.F08.1.454.CMB.2.raw
  modified_base (411)..(411): a, c, t, g, unknown or other
  misc_feature (411)..(411): n is a, c, g, or t
  modified_base (456)..(456): a, c, t, g, unknown or other
  misc_feature (456)..(456): n is a, c, g, or t
tcagtcacgtactacacgaccggtgctcgatttagcgatcgtataaggggacccaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttactattttcgactaacttttggcatctacgtggggtgcgacgacggccccctggccaccggcttggagtcgcgtggagtggatcagttgttacacggtgacacagtacttgctacagaagtttggagggccagacgtccaccctgacccacagaccacactcccgacaaacncagaccctaacagtaggaaactgaaggtaaactccgtagaacctntaccgtacgaaaccgaccgaaccggtaccctaaattaactttaaacttacgtcgtaggacgggtaaacgggtaacggggttacgggggttttacgggggcgtaccggggtaaccttccgtcgtttaggacggttacgtcggggtcgggggacccgaagggggtaacaacggttcgggtacctacccggttctaccttccgtaacccg

SEQ ID NO: 351773 - DNA, 802 bp, Homo sapiens
  misc_feature: GZ8MTXP02GWNNL.13.63.F08.1.454.CMB.2.raw
tcagtcacgtactacacgaccggtgctcgatttagcgatcgtataaggggacccaaaaaaccacacccctccttgggagaatcccgtagatcacagctcctcaccatggactggacctggagcatccttttcttggtggcagcggcaacaggtgtccaccctgaggttcagttggttcagtctgggagggaggggtgaagaagccgtggggcctcagtgcaggtcgcctgcgagggcctcgtggttactattttcgaactaacgtttggactattctacgtgggtcgcgacgacggccccgtggcccgacggtccttaggacgtcgcgtggggtgatcgtagttcgttaacgaacggttgaactagtaacgtactttcgacaacgtagtaaagtttggacgggtcaacggtacgtccaccctacgaccaacgagaccacacgtacccgacgaaccacacgaccctaacgacgtaacggaaacgtaggaaaggtaacttacgacgaacgtacttacgacgaaccgaaaccgaccggtaaccctaattaaacgttacgtttaaacgtcggtacggtaacgggtaaacggggttaaacggggttttacgggggtttttacggggacccgggttaccgggtaaccctttaccggtttaccggtttagggtaaccgggttaacggttcccgggggttacgggggtaaccccgggaaacgggggtaaaccttaaacggggttacccggttaacccggtaccccggtttacgttacccgtttaacccggaacccgtttaaaccccccgg

SEQ ID NO: 351774 - DNA, 720 bp, Homo sapiens
  misc_feature: GZ8MTXP02JCTSG.13.63.F08.1.454.CMB.2.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagagccgtggggtctcgagtgcaggtccgcctgcagggcctcgtggttactattttcgactaacgtttggctattctacgtgggtgcgacacggcccctggcccacggtccttggacgtcgcgtggggtgactcgtagttgttaacgaacggtgaacacagtactttgctacgagtagtttggaggtcacgacgtccacccgtagaccctaacgacgtaccactacgtcccgacgaaacctacgactaccctaacgtacgtaggaaacgttgaaaggtaaacctcgttacgaactacgtaccgtagaacccgtaacgaccggacctaaagttacttaacttaccgtagtacgtacggtaaacggtaagggggtttaccgggttttcggggacgtacgggtacctttaccgttcggttaggacgtaacgttccgggttacggggaacccggtaagggtaaaaccgtaacgggtttaccggaccgtttaacccggtcgtttacccgtaccgtaacggttaaccccccg

SEQ ID NO: 351775 - DNA, 673 bp, Homo sapiens
  misc_feature: GZ8MTXP02I99J9.13.63.F08.1.454.CMB.2.raw
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagagccgtggggcctcgagtgcaggtcgcctgcgagggccttcgtggttactattttcgactaacgtttggctattctacgtgggtcgcgacgacggccccgtggccgacggccttgacgtcgcgtggggtgatcgtagttcgttaacgacggtgaacanagtactttgactanaacgtagtttgaggcacgacgtcctacccgagtacacgagacncactccgacgaaacncgacgtacctaanacgtacgaacgtagaacggtaactacgtacgaactacttacgacgaaccgaaccgaccggtaacaattacttaacttacgtaggtcgaaggtaacggtaaggttaacggggtttggggccgtacggtaccgttccgtaccgttaggacgtaacggtcggtcggggtaaccggtagggtaaccgttaacgtacggtacccgtaccgttaccgttccgttaccgaacccgtccccg

SEQ ID NO: 351776 - DNA, 538 bp, Homo sapiens
  misc_feature: GZ8MTXP01C9AN7.4.14.B03.1.454.CMB.2.raw
  modified_base (198)..(198): a, c, t, g, unknown or other
  misc_feature (198)..(198): n is a, c, g, or t
tcagagcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtggganacagagtcactatcacttgccgggcagtcagagcattagtggctggctggcctggtatcagcagaaaccagggagacgcccctaagctcttgatctttgatgccactaagttggaacgtggggtaccatcaagaattcaaggcgcgaggtggagtttgggacagtaattcactctcacatcagcagcctgctagccgttggggtgtattttgactaattattactgacctaaatagttaataattagttaattcttactcgttacgtttacgggcgggttaacgggaccgttaagggtgggtaacgaagttacgaaaacgttacgttgttcgggtaaccg

SEQ ID NO: 351777 - DNA, 687 bp, Homo sapiens
  misc_feature: GZ8MTXP01BOPT5.4.14.B03.1.454.CMB.2.raw
  modified_base (198)..(198): a, c, t, g, unknown or other
  misc_feature (198)..(198): n is a, c, g, or t
  modified_base (239)..(239): a, c, t, g, unknown or other
  misc_feature (239)..(239): n is a, c, g, or t
tcagagcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtggganacagagtcactatcacttgccgggcagtcagagcagttagnggctggctggcctggtactcgagacaagaaaccgagggacacgacccctaagcttcttgattctttgactcgacctaactaaagtttacgggaaacggtcggggtaccagtaccaaaggtaacttcgaaggcgggtacgtaagggttgggtagtttcggggaaactaaggtaaacttcctaactcctacaaccctaagttaccgaacggtacaaccggtccttacggacctaacgggttcccgttagggggtttacgttactttttcgaacctttaaacgtttaacttaccgtacggtaaccctaaaagtagttaaactttaagttactttaactttccttacgttccgttaaccgggtttcgggaaccggggttaacggggttaaccgttaaagggttaacggaagtaacgttaaacgaaacccggttagttaacggttcggtaacg

SEQ ID NO: 351778 - DNA, 534 bp, Homo sapiens
  misc_feature: GZ8MTXP02HPJ7N.4.14.B03.1.454.CMB.2.raw
  modified_base (198)..(198): a, c, t, g, unknown or other
  misc_feature (198)..(198): n is a, c, g, or t
tcagagcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtggganacagagtcactatcacttgccggccagtcagagcatagtggctggctggcctggtatcagcaagaaaccgagggagagcccctaagctcttgatctttgatgccactaatttggaaagtcggggtcccatcaagtattcaggcggcagtggtagtttgggacagaaattcactctacaccatcagcacgctgcagcctggtgtatttgactaaacttattactgacctaatagttaataaattatttaacttcttctacttacgtttcgggacgggaacgggtaccgaaaggggtaaggaaggaacttacgaaaacgtacgtacggttaggtaccg

SEQ ID NO: 351779 - DNA, 506 bp, Homo sapiens
  misc_feature: GZ8MTXP02GX9B5.4.14.B03.1.454.CMB.2.raw
  modified_base (198)..(198): a, c, t, g, unknown or other
  misc_feature (198)..(198): n is a, c, g, or t
  modified_base (342)..(342): a, c, t, g, unknown or other
  misc_feature (342)..(342): n is a, c, g, or t
tcagagcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtggganacagagtcactatcacttgccgggccagtcagagcattagtggctggctggcctggtatcagcaagaaaccagggagacgcccctaagctcttgatctttgatgccactaatttggaaagtggggtcccatcaagattcagcgnaggtgatttggggacagaattcactctcacatcagcagcctgcagcctggtgtatttgactaactttattactgaccaaacagttaataatagtttacttctctctacgtttcggacggacgggaccaagggtgagtaactacgaaaacgtacgtggtagtacg

SEQ ID NO: 351780 - DNA, 507 bp, Homo sapiens
  misc_feature: GZ8MTXP02FLQHH.4.14.B03.1.454.CMB.2.raw
  modified_base (334)..(334): a, c, t, g, unknown or other
  misc_feature (334)..(334): n is a, c, g, or t
tcagagcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccggcagtcagagcattagtggctggctggcctggtatcagcagaaaccagggagagcccctaagctcttgatctttgatgccacaatttggaaacgtgggtaccatcaagtattcngcgcaggtgagtttagggacagtaattcactctcaccatacagcagcctagcagcctggtgtacttttgactaaactttattactgactaacagtataatacgttactctctctacgttcggacggtacggaccgtaaggtggacgacgtacgaaacgtaacgtgtacggtcg

SEQ ID NO: 351781 - DNA, 592 bp, Homo sapiens
  misc_feature: GZ8MTXP02HBIBE.4.14.B03.1.454.CMB.2.raw
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
  modified_base (440)..(440): a, c, t, g, unknown or other
  misc_feature (440)..(440): n is a, c, g, or t
tcagagcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtggganacagagtcactatcacttgccggcagtcagngcattagtggctggctgggcctggtatcgagacaagaaaccgagggagacgacccctaagcctcgttgacttcgtttgatcgacctaaccgtaaagtttaggaaacggttcggggtaccctaagtaccaaagtacttacgacgggcggtactaagggtggtagtttagggggactaaaggtaattcacttctacacatcacgcacgtccgngcacgtccgttaggtcgttatttcgacttaacttatactcgaaccaagtattaataagttatttactcttactactacggtttcgggacggtaacggtaccgaaaggtaaggacgttaaacgaccgtaaaaccgtaagttcggtaggtaccg

SEQ ID NO: 351782 - DNA, 637 bp, Homo sapiens
  misc_feature: GZ8MTXP02GTE3D.4.14.B03.1.454.CMB.2.raw
  modified_base (200)..(200): a, c, t, g, unknown or other
  misc_feature (200)..(200): n is a, c, g, or t
tcagagcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacataccaaatgacccagtcctccttccaccctgtctgcatctgtggganacagagtcactatcacttgccggcagtcagagcagttaggtggctggctggcctggtatcagacaacgaaaccgagggacacgaccctaagctctgtattctttagactcgacctaacgtaagtttaggaacggtcggggtacccatacgaagtacttacgaggcggacgtaggtagtagttacggaactaagtaaactcaacctctaccactatacacgactacgccgtagaccgtacgtccgttgggttactttacgtttacgaaccttaaacgtttacttaacctacggtaaccctaaagttaagttaatttaaaagttacgtttttactaccgttacttaccggttacggtttaccggggaacggggtaacggtaaccggtaagggtaacggtaacgtacgttaaaccgaaacgttacggtggtacggtaccg

SEQ ID NO: 351783 - DNA, 530 bp, Homo sapiens
  misc_feature: GZ8MTXP02GTR8Y.4.14.B03.1.454.CMB.2.raw
  modified_base (198)..(198): a, c, t, g, unknown or other
  misc_feature (198)..(198): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
tcagagcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtggganacagagtcactatcacttgccggcagtcagagcattagtggctggctggcctggtatcagcaagaaaccgagggagacgcccctaagctcttgatctttgatgccacaatttggaaacgtggggtcccatcaagtnttcngtcgcagtgattgggacagtaatcactctcacatacagcagctgcagcctggtcgtatttgactaacttattactgacctaacagttaataaattagttaacttcttacttctaaccgtttcgggaccggtaacgggtaaccgtaaggggtggaacgtaacgtaaccgaaaacggtaccttaggtacggtcg

SEQ ID NO: 351784 - DNA, 553 bp, Homo sapiens
  misc_feature: GZ8MTXP02JJ4RU.4.14.B03.1.454.CMB.2.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (425)..(425): a, c, t, g, unknown or other
  misc_feature (425)..(425): n is a, c, g, or t
tcagagcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtcctccttccacctgtctgcatctgtggganacagagtcactancacttgccggccagtcagagctattagnggctggctggcctggtatcgagcaagaaccgaggacgacgcccctaagtcctctgacttcttagatcgacctacgtaagtttaggaaacggttcgggtaccctagtacgaagtacttacgacggcggtcgtaaggttggtaagttgggaactaggtaacttcactctacacatcagcagcctgacngtctaggtcttatttcgacttaacttacttcacgtacctaaatagtaattaacgttagttacttctctacgtacgttacggacggtacggtacgtaaggcgaagtacgacgtaaagtactggtacgcg

SEQ ID NO: 351785 - DNA, 622 bp, Homo sapiens
  misc_feature: GZ8MTXP02FT1G6.4.14.B03.1.454.CMB.2.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
  modified_base (573)..(573): a, c, t, g, unknown or other
  misc_feature (573)..(573): n is a, c, g, or t
  modified_base (587)..(587): a, c, t, g, unknown or other
  misc_feature (587)..(587): n is a, c, g, or t
tcagagcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacataccaaatcgacccagtcctccttccaccctgtctgcatctggtggganacgagagtcactatcacttcgccggcagtcaganctagttgngctggctggcctgtancgagcaagaaccgnggagaccaccctagctgttgatttcgttagacgttccgaaccctaagttaaagttttacgggaaaccggtccggtacccctagtaacgaagtacgttcgacggggcgacgtaggttacgtaggttaggaaacctaagtaactttccacttcaaccctaacngtacgacgtacgaccgtnacgcgtacggtcgtggttacttattacgaaactttaacgttaactcgacgaaaccttaagtaagttaattaagttactttactcgtcttaccgttaccgggttacggacggggtaaaacnccggttaaaagggngtaaacgtacgtaacggaacgtacgtcggactacg

SEQ ID NO: 351786 - DNA, 669 bp, Homo sapiens
  misc_feature: GZ8MTXP01A98XT.41.2.A02.1.454.CMB.2.raw
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
tcagtctatactatcacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctcgtggcgagaggccaccatcacctgcaagtccagccacactgatacagtccaagttgagtattacttggttgtancaacgagaagcaggacagcctctaggttcctntagtttacggacagtccgagggccggctagtcccgggggtccctggacccgtattccccgaggtccgccgaggccggggttaacctgggggaaccagggtacccgtttccggcctaaccgtccaaaccgtactaccgaacggcccgtaggccgaaggggttacgaaaggtacttcgttacgacttaacttaacgttacttacgtcgaagtactaagttaacgttttacggaaaccgtccccgttacgtaacccgggtttccggggaccgggggtaccgtacggggttcggaacgttcggaacgggaccgttaacggtcggtcggttcgttcggaccgtaaccctattccgttcgttccttacctaacgtttccccttccccg

SEQ ID NO: 351787 - DNA, 579 bp, Homo sapiens
  misc_feature: GZ8MTXP02F017C.41.2.A02.1.454.CMB.2.raw
tcagtctatactatcacgaccggtgctcgatttagactcatctacagggggccacaacaggcaggcaggggcagcaagatggcgctgcagacccaggtcttcatttctctgttgctctggatctctggagcctacggggacatcgtgctgacccagtccccagactccctggctgtgtctctgggcgagagggccaccatcacctgcaagtccagccacaaccttggatacaggtccaacgttgagtaattacgttggtttggtatcaaacagaaggcaggacagcctctaggttcctcatttacggacatccgaggcgggcagtcccggggtcctgaccgattcccagccgccaggcgggtctgggacagacttcgcactcaccatcaacgcctgcgagggtgaagatcgttagactaaacttattactgtacagtctagttatttagaaaccgtcccctagtaccgtttcggggacgggggtaccgtaggggtacggaaccgtcgacggtacgtaaacgtggtacggcctggacctaaccgtacttcgttacgttccttacgtaccttccttccccg

SEQ ID NO: 351788 - DNA, 653 bp, Homo sapiens
  misc_feature: GZ8MTXP01B2Y0Y.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttcgcgtaggctctttaagaggtgtccagtgtcaagtgcaactggtggagtcgtggggggggctggtccagcctgggaggtccctgagctctcctgtgcaggctctggattcacccttcagtaacgtacggcgtgctacgtcgggtcccgccgaggcctccgaggacgaagggtcttggagtggcgtggctaggtttgtttcagtcgtaggaaggtaagtagttaactaactaactaactaacacgtacgtaccgtacggacgggacgtacttactacctactactaccacgaacgaactaactaaccaaacgaaacgaacgtaactagttacgttactacgtaacgaaacgtacgtaacgaacgtacgtaagtaagtaggaacggtaacgtacggtaacgttagtttagtttaacgttacggtaaacggtaaagggaagggggttaacggttaacgtaaggtacggtaacgacgtaccgttaccgtaacgttaacgttaacg

SEQ ID NO: 351789 - DNA, 527 bp, Homo sapiens
  misc_feature: GZ8MTXP01BEYS8.8.38.D05.1.454.CMB.2.raw
  modified_base (289)..(289): a, c, t, g, unknown or other
  misc_feature (289)..(289): n is a, c, g, or t
  modified_base (361)..(361): a, c, t, g, unknown or other
  misc_feature (361)..(361): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccaccagttagcctggtaccaacacaaacctggccaggctccaggcccctnatcttgatgcatccatcagggccactggcatcccagccaggttcagtggcagtggtctgggacagaacttcnctctcaccatcagcagctagagctagagtattttgcttattttatactgtcagcaggcgttagtactggtacctttcactttcggcccttggggaacctaaagtcggataatacgaaacgaacttgtacggcttggcacctaatcctgttcttcactccttcccgc

SEQ ID NO: 351790 - DNA, 549 bp, Homo sapiens
  misc_feature: GZ8MTXP01EB0S5.8.38.D05.1.454.CMB.2.raw
  modified_base (307)..(307): a, c, t, g, unknown or other
  misc_feature (307)..(307): n is a, c, g, or t
  modified_base (441)..(441): a, c, t, g, unknown or other
  misc_feature (441)..(441): n is a, c, g, or t
  modified_base (476)..(476): a, c, t, g, unknown or other
  misc_feature (476)..(476): n is a, c, g, or t
tcagctcgcgtgtccacgaccggtgctcgatttagtatctgatagttgggtttggggggcgtggtccagcctgggaggtccctgagactctcctgtgcagcctctgggttcaccttcagtagctacggcatgcactgggtccgccaaactccaggcaagggattggagtgggtggcagttgtttcatctgagggcagtgttcaatggtatgctgacgccgtgaaggccgattcaccattctccagagacaactccaggaacacaatgtattggacctgaacagcctaaagtcctgaggacacgggtntatactactgtacgaaggagggggaaccaggcggagtccaaagtactccctttgacgtcgtggggcccaagggtaccctggtccaccggtctcctcagcctccaccaaggcccagtccgtcttccccctggccnccctgcctccaggacgccaccgtccgagacgcacncgcggccctgggcctgccctggcaaggccttactccgacacgcgagcttggaagcgggctgggcaggcgcaag

SEQ ID NO: 351791 - DNA, 526 bp, Homo sapiens
  misc_feature: GZ8MTXP01BGZXP.8.38.D05.1.454.CMB.2.raw
  modified_base (290)..(290): a, c, t, g, unknown or other
  misc_feature (290)..(290): n is a, c, g, or t
  modified_base (363)..(363): a, c, t, g, unknown or other
  misc_feature (363)..(363): n is a, c, g, or t
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttcgcgtaggctctttaagaggtgtccagtgtcaagtgcaactggtggagtcgtgggggggctggtccagcctgggaggtccctgagactctcctgtgcaggctctggattcactcagtactacggctgcactgggtccnccaggctccaggcaagggcttggagtggctggcagttgttcatctgaagatgttacaatcatacagactccgngaagggccatcaccatctccagaanacatacaagacanatagtagtntagacaagtagacgacgacgtaagagtagagacgacgtcgtgttagttacgttagtaacggtaagggaggggaggttacgaaggtaggcgacgcgttactaacgttaacgttaacg

SEQ ID NO: 351792 - DNA, 536 bp, Homo sapiens
  misc_feature: GZ8MTXP01BEHUA.8.38.D05.1.454.CMB.2.raw
  modified_base (301)..(301): a, c, t, g, unknown or other
  misc_feature (301)..(301): n is a, c, g, or t
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
  modified_base (506)..(506): a, c, t, g, unknown or other
  misc_feature (506)..(506): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggttttcctcgttgctctttaagaggtgtccagtgtcaagtgcaactggtggagtcggtggggggggctggtccagcctgggagtccctgagactctcctgtgcaggctctggacttcaccttcaagtaactacggcgtgcacgtgggtcccnccgaggcctccgaggcaagggcttggagtggctggctagttgtttcagtcgtaggaagtagtgttaacaatctatacagactcgtgaagggccatcacatctcaganacaatccaagacagatagtatctgacaaagnggaacagaccgtaaagngttagaggacaggtctggttattacgttaggtaagaaggagggggttaanagaagtcgcgagcttacgtaagttcgtaag

SEQ ID NO: 351793 - DNA, 513 bp, Homo sapiens
  misc_feature: GZ8MTXP01EVW9T.8.38.D05.1.454.CMB.2.raw
  modified_base (482)..(482): a, c, t, g, unknown or other
  misc_feature (482)..(482): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctggggaggtccctgagactctcctgtgcaggctctggattcactcagtaactacggcgtgcactgggtccgccaggctccaggcaagggcttggagtggctggcagttgtttcatctgaaggagtgttaacaatctatacagactccgtagaagggccgattcaccatctccagagacaatccaagaacacgatgtatctgacaaatggacagcctaaagagttgagacacggctgttatattgtagaagagggggnttagaagtgcagcacctaagttaacttaacg

SEQ ID NO: 351794 - DNA, 631 bp, Homo sapiens
  misc_feature: GZ8MTXP01DC1ZZ.8.38.D05.1.454.CMB.2.raw
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
  modified_base (347)..(347): a, c, t, g, unknown or other
  misc_feature (347)..(347): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttcgcgtagctcttaagaggtgtccagtgtcaagtgcaacgtggtggagtcggtggggggggctggtccagccgtgggacggtccctgagctctctgtgcaggctctggattcactcagtaactcggcgtgcncgtggccncaggctcgaggcgaaggctggagtggctggtntgttgtcacgtcgtaggagtactntaacaatctatacgacgtacgtacggtaggaacggcctattccacctatccgtacgaagaacgaactaactaaccgaaacgaaacgaacgtaacgtacgtaacgtacgtaacgtaacgtaaacgtaacgaacgtaacgtaacgtaacggtaaggtaggtaacggtacgtacggttaacgttacgtttaacgttaacgttaacggtaaacgggtaaggggttaaggggttacggttaacggtaaggtacgaacgtacgtacgttaccgtaacgttaacgttaacg

SEQ ID NO: 351795 - DNA, 525 bp, Homo sapiens
  misc_feature: GZ8MTXP01C6OF1.8.38.D05.1.454.CMB.2.raw
  modified_base (505)..(505): a, c, t, g, unknown or other
  misc_feature (505)..(505): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggagtccctgagactctcctgtgcaggctctggattcacctcagtaactacggcgtgcacgtgggtcccgccaggctccgaggcaagggctggagtggctggcagttgttcatctgaaggatgtaacaatctatacagactccgtagaagggccgattcacatctccagagacataccaaagacacgatgtagtctagacaaagtgacagactaaagagttagaggacgacggtcttagttattacgttggtaaagaaggaggggattacgaagtgnaggcacctaagttcttaacg

SEQ ID NO: 351796 - DNA, 532 bp, Homo sapiens
  misc_feature: GZ8MTXP01EEKT4.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcacctcagtaactacggcgtgcactgggtccgccaggctccaggcaagggcttggagtggctggcagttgttcatctagaaggagtgttacaatctatacagactccgtgaaggccgattcaccatctaccagacgacaattaccaaagaacacgatagtatactgacaaagtgacagcctaaagagttgaggacacggtcttgtttatacttaggtaacgaaaggagggggattacgaagtggcagcttacaagttaacgttaacg

SEQ ID NO: 351797 - DNA, 556 bp, Homo sapiens
  misc_feature: GZ8MTXP01A8UN1.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcacctcagtaactacggcgtgcacgtgggtccgccaggctccgaggcaagggcttggagtggctggctagttgtttcatctaggaaggatgttacaatctatacagactcgtgaacgggccgatcacatctccagagacaattaccaagaacacgatcgtatctgaccaaatggacagacctaagagttggacggacacgggtcttgtttagttacgttaggtaaacggaaagggaagggggttattacgaaggtaggcgtaggccttaccgtaacggttaactttaaccg

SEQ ID NO: 351798 - DNA, 532 bp, Homo sapiens
  misc_feature: GZ8MTXP01EV6XU.8.38.D05.1.454.CMB.2.raw
  modified_base (448)..(448): a, c, t, g, unknown or other
  misc_feature (448)..(448): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagctctcctgtgcaggctctggattcacctcagtaactacggcgtgcactgtgtccgccaggctccaggcaagggctgggagtggctggcagttgttccatctgaaggagtgttacaatactatacagactcgtagacgggccgattcacatctccaagacgacaataccaagaacacgatggtatctagacaaatggacagacctaagngttagaggacaacgggtcttagtttaattacgtgtaaggaaaggagggggataacgaggtggcaggactccgttaagttaaccg

SEQ ID NO: 351799 - DNA, 556 bp, Homo sapiens
  misc_feature: GZ8MTXP01DJRIZ.8.38.D05.1.454.CMB.2.raw
  modified_base (258)..(258): a, c, t, g, unknown or other
  misc_feature (258)..(258): n is a, c, g, or t
  modified_base (296)..(296): a, c, t, g, unknown or other
  misc_feature (296)..(296): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggttttcctcgttagctctttaagaggtgtccagtgtcaagtgcaactggtggagtcgtgggggggctggtccagcctgggaggtccctgagactctcctgtgcaggctcnggattcacctcagtaactacggctgcacgtgggtcccnccaggctccaggcaagggcttggagtgctaggctagttgtttcatctagaaggtatgttaacaattcaagtacagactccgtagaacgggcccattcactatctaccagagacaataccaagacagatagtactctagacaatagacgacgactaagagtgaggacgacggtcgttagtttagttacgttacggtaacggtaaagggaaggggttagaacgaagtaggaacgagacttaccgtaacgttaactttaaccg

SEQ ID NO: 351800 - DNA, 544 bp, Homo sapiens
  misc_feature: GZ8MTXP01AY751.8.38.D05.1.454.CMB.2.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctggggagtccctgagactctcctgtgcaggctctggattcacctnagtaactacggcgtgcacgtgggtcccnccaggctccgaggcaagggcttggagtggctggctagttgttcattctagaaggaatgtaacaatcgtatacagacctccggtagaaacgggcccgtattcaccatctaccagagacaataccaagaacacgatagtatctagacaaagtggacagacctaagagttgaggacncggnttgttatacgttaggtaacgtaaggagggggattacgaagtggcagcttacctaagttaacgttaacg

SEQ ID NO: 351801 - DNA, 540 bp, Homo sapiens
  misc_feature: GZ8MTXP01DV9ZV.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggcgtggtccagcctggggaggtccctgagactctcctgtgcaggctctggattcacctcagtaactacggcgtgcacgtgggccgccaggcctccgaggcaagggcttggagtggctggcagttgttcatctagaaggtagtgtacaatctatacagactcgtagagggccgatcacatctcagagacaataccaagaacacgatgtatctgacaaatggacagacctaaagagttagaggacagggaacttgttattacgttaggtaaacggtaaagggagggggattaacgaagtggaacaggaccttactaacgttaacttaacg

SEQ ID NO: 351802 - DNA, 553 bp, Homo sapiens
  misc_feature: GZ8MTXP01AMTOG.8.38.D05.1.454.CMB.2.raw
  modified_base (300)..(300): a, c, t, g, unknown or other
  misc_feature (300)..(300): n is a, c, g, or t
  modified_base (414)..(414): a, c, t, g, unknown or other
  misc_feature (414)..(414): n is a, c, g, or t
  modified_base (526)..(526): a, c, t, g, unknown or other
  misc_feature (526)..(526): n is a, c, g, or t
tcagctcgcgtgtccacgaccggtgctcgatttagtatctgatagttgagctctgggagaggagcccggcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggctgcacgtggggtcccnccagggcctccgagggcaaggggcttgggagtggctgggctaggttgtttcatccgtaggaaggtaagtgttacaaattactaatacagactccgtgaacgggccatcacatcnccagagaacaataccaagaacacgatagtatcgtgacaaatggacagcctaagagtgagacacggctaagttattacgtggttacgtaaagggagggggagttacgagtggnaacgctaccaagttcgttaacgtttcg

SEQ ID NO: 351803 - DNA, 579 bp, Homo sapiens
  misc_feature: GZ8MTXP01CXQ4H.8.38.D05.1.454.CMB.2.raw
  modified_base (291)..(291): a, c, t, g, unknown or other
  misc_feature (291)..(291): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaagacgcccaccctctcctgcagggccagtcagagtgttaccaccagttagcctggtaccaacacaaactggccaggctccagcccctnatcttgatgcatccatcaggccactgcatcccagcctaggttcagtggctaggtgggtctgggacagaacttcaactctcaccatcagcagcctagacgctagaagtatttagacttaagtttattactgtacaactacgtacggtaaccgaggtcggcccggtccgggggccctaccggtttccggacccgtacgggtaaaccctaaaagttcgaagtaactacgaaacgtaacttggtacggcttacgcaccgtaatcttgttcttcttacttcccttcccgaacc

SEQ ID NO: 351804 - DNA, 523 bp, Homo sapiens
  misc_feature: GZ8MTXP01AV65P.8.38.D05.1.454.CMB.2.raw
  modified_base (453)..(453): a, c, t, g, unknown or other
  misc_feature (453)..(453): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctggggaggtccctgagactctcctgtgcaggctctggattcacctcagtaactacggcgtgcactgggtcccgccaggctccaggcaagggcttggagtggctggcagttgtttcatctagaaggatgttacaatctatacagactcgtgaagggccgattcacatctccagagacaataccaagacacgatgtatctgacaatggacagacctaagagttagagtacncgggctgtttatacttagtaacggaaaggagggggattacgaaggtgcagcttacctaagttcgttaacg

SEQ ID NO: 351805 - DNA, 668 bp, Homo sapiens
  misc_feature: GZ8MTXP01EUMY5.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcacctcagtaaactacggcgtgcactgggtccgccaaggctccaaggcaaaggggcgttggagtggcgtggcgtagttgttctactctagaaggaagtagttaactaaataactaaataaacaacgacgtaccgtacggaaacgggaccgtacttactaaccaactactaccaacgaacgaactaaactaaccaaacgaaaacaaacgtaagtagttaacgttactacgtaacaaaagtaaggaacgaacgaaccgtaaacgtaaggttaggtaacgggaacgaacggtaacgttacgttttaagtttaaacgttaacggtaaacgggtaaaaggggaaaggggggaaagggttaaacggtaaggtaggaacgacgacgttaccgtaaacgttaaacgttaacg

SEQ ID NO: 351806 - DNA, 658 bp, Homo sapiens
  misc_feature: GZ8MTXP01E1688.8.38.D05.1.454.CMB.2.raw
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggtttcctcgttgctcttttaagaggtgtccagtgtcaagtgcaactggtggagtctgggggctgggtccaggcctaggggacggtccctagagctctctgngcngctctgtatctactactacgtacgtacggcgtcgcgacgtcggtccgccgacgcgtccgacggacgaacgggtcggtaggtaggtggtcgtggtcgtagttcgttacgtacgtacgtagtaaggtaagtagtaactaactaactaactaacgtaacgtacgtaccggtacggaacgggtaccgtactacacctactactacgacgaacgtaactaactaacaaacgaaacgtaacgtaagtagtacgtacgtagtaacgaaagtaacgaacgaacgtaacgtaagtagtaggtacggaacgacgtaacgttagtttaacgttaacgttacggtaaacggtaaagggttaaggggacgttacgtaaggtaggtaacgacgtacgttacgtaacgttaacgttaacg

SEQ ID NO: 351807 - DNA, 525 bp, Homo sapiens
  misc_feature: GZ8MTXP01AVD63.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcacctcagtaactacggcgtgcactgggtccgcaggctccaggcaagggcttggagtggctggctagttgtttcatctagaagagtgttacaatctatacagactcgtgaacgggccgattcacatctcagagacaataccaagaacacgatgtatctagacaaagtggacagacctaagagttgagacgacgtctgtttattacgttagtaacgaaggagggggattacgaaggtgcgagcgttactaacgttcttaacg

SEQ ID NO: 351808 - DNA, 554 bp, Homo sapiens
  misc_feature: GZ8MTXP01DBMFG.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactgggtggagtcgtggggggggctggtccagcctgggaggtccctgagactctcctgtgcaggctctggattcacctcagtaactacggcgtgccacgtgggtcccgccaggcctccgaggcaagggcttgggagtggctggctagttgtttcatctagaaggtagtgttaacaattctatacagtactcgtagaaggccgattcaccatctaccagagaactaactaccaaagaacacgatgtatctagacaaatggacagactaaagagttgacgacacggtcttagtttattacgttagtaaacggaaaggagggggattacgaagtggcacgtacttacctaacgttaacgttaacg

SEQ ID NO: 351809 - DNA, 526 bp, Homo sapiens
  misc_feature: GZ8MTXP01BQE8E.8.38.D05.1.454.CMB.2.raw
  modified_base (502)..(502): a, c, t, g, unknown or other
  misc_feature (502)..(502): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcacctcagtaactacggcgtgcacgtgggtcccgccaggctccgaggcaaggggcttggagtggctggcagttgttcatctaggagagtgtacaatctatacagactcgtgaagggccgattcaccatctcagagacaattaccaagaacacgatgtatctgacaatgacagctaagagtgaggacacggtctgtttatacgttagtaacggaaggagggggattacgaaggtgcgngcttaccgtaagttaacgttaacg

SEQ ID NO: 351810 - DNA, 595 bp, Homo sapiens
  misc_feature: GZ8MTXP01B23Z3.8.38.D05.1.454.CMB.2.raw
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttcgcgttaggctctttaagaggtgtccagtgtcaagtgcaactggtggagtcgtggggggggctggtccagcctggggaggtccctgagactctcctgtgcaggctctggattcacctcagtaactcggctgcactgggcccncgagcncgaggcgagggtctggagtggctggctagttgttcacgtcgtaggaagtagtgtaaacaattctataacgagtacgtcggtaggaacggcctattccactatcacgaagaacactaactacaacgaacaacgatagtagtactagtacaagtacgacgacgacgtaagtagtaggaacggacgtacggtaacgttagtttagttacgttacggtaaacgggtaaaggggttaagggggttacggttacggtaaggtaggtaacgacggtacgttaccgtaacgttaacgttaacg

SEQ ID NO: 351811 - DNA, 526 bp, Homo sapiens
  misc_feature: GZ8MTXP01A2NNU.8.38.D05.1.454.CMB.2.raw
  modified_base (297)..(297): a, c, t, g, unknown or other
  misc_feature (297)..(297): n is a, c, g, or t
  modified_base (503)..(503): a, c, t, g, unknown or other
  misc_feature (503)..(503): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctggggagtccctgagactctcctgtgcaggctctggattcacctcagtaactacggcgtgcacgtgggtcccnccaggctccaggcaagggcttggagtggctggctagttgttcatctagaaggatgtaacaagtctatacagactcgtagaacggcgatcacgtctccagagaacaatacaagaacacgatagtatctagacaaagtgacagacctaagagttgaggacacgctaagttattacgtgttaacgaaaggagggggattacgagtgganaagctacaagtcttaagttaacg

SEQ ID NO: 351812 - DNA, 542 bp, Homo sapiens
  misc_feature: GZ8MTXP01AJ5JW.8.38.D05.1.454.CMB.2.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (384)..(384): a, c, t, g, unknown or other
  misc_feature (384)..(384): n is a, c, g, or t
  modified_base (518)..(518): a, c, t, g, unknown or other
  misc_feature (518)..(518): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaactggccaggctcccaggcccctnatcttgatgcatccatcagggccactggcatcccagccaggttcagtgcagtgggtctggggacagaacttcaactctcacatcagcagcctagngctgaagtatttgctagtttatactgtacaactatacgggtacgaggtcgcccgtccgggggcctacgtttcggacccttaggggaacctaaaagttcgagtaactacgaaacgacttggtcggcttcgcactntctgtcttcacttccttcccgtcc

SEQ ID NO: 351813 - DNA, 535 bp, Homo sapiens
  misc_feature: GZ8MTXP01D7YGX.8.38.D05.1.454.CMB.2.raw
  modified_base (475)..(475): a, c, t, g, unknown or other
  misc_feature (475)..(475): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggagtcgtggggggggctggtccagcctgggaggtccctgagactctcctgtgcaggctctggattcacctcagtaactacggcgtgcactgtcgtccgccaggcctccgaggcaaggggtcttgggagtggctggctagtttgtttccatcgtagaaggtatgttacaatactatacagactcggtagaacggcgattcacatcaccaagacacaataccaaagaacacgataggtatctagacaaatggacagactaagtagtgagcaacggtnttagttattagtaaggtaaggaagggaggggataagagtcgcagactaacgttaagtaac

SEQ ID NO: 351814 - DNA, 585 bp, Homo sapiens
  misc_feature: GZ8MTXP01EZCEJ.8.38.D05.1.454.CMB.2.raw
  modified_base (300)..(300): a, c, t, g, unknown or other
  misc_feature (300)..(300): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctggggaggtccctgagactctcctgtgcaggctctggattcacctcagtaactacggcgtgcacgtgggtcccnccaggctccgaggcaaggggcttggagtggctggctagtttgtttcatcgtaggaaggtaagtgttaacaaatctatacagtactccggtaggaaacgggtcccgattacaccatactccagaacgacaacttaccaaagaacaacgatagtatctagacaaagtggaacagaccgtaaagtagttaggaggacgacggtcgttagttttaagtacgttaggtaacggaaaagggaggggggttattacgaaggtaggcgagcttaccgtaacgttaacttaacg

SEQ ID NO: 351815 - DNA, 594 bp, Homo sapiens
  misc_feature: GZ8MTXP01BG2HL.8.38.D05.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (405)..(405): a, c, t, g, unknown or other
  misc_feature (405)..(405): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccacctgtctttgtctccgaggggaaanagccaccctctcctgcagggccagtcagagtcgtaccaccagttacgcctggtaccaacacaaacctggccaggctcccacggcccctnatctttgatgcatccatcgagggcccatggccatcccagcctaggttcaggtggcaggtgggtctgggacagaacttcaactctcaccatcagcagcctagacgctagaagtnttttagctttaagtttatactgtacaactatacggggtacgtaggtcggcccggtccgggggccctacggtttccgggacccgtaggggtaaaccctaaaagttcgaagtaactaacgaaacgtacttggtcggtcttacggcttaccctaagtccttaacgttccttcttaccttccttcccgtaacc

SEQ ID NO: 351816 - DNA, 542 bp, Homo sapiens
  misc_feature: GZ8MTXP01AULJR.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctggggaggtccctgagactctcctgtgcaggctctggattcacctcagtaactacggcgtgcacgtgggtcccgccaggcctccgaggcgaagggcttggagtggctggcagttgtttcatctgaaggagtgttacaatctatacagactcgtgaacgggccgattcacatctaccagagactaatccaaagaacacgatgtatctagacaaatggacagacctaaagagttagaggacgacggtcttagtttatacttggtaaacggtaaaggagggggattacgaaggtgcgagcttactaagttaacttaacg

SEQ ID NO: 351817 - DNA, 602 bp, Homo sapiens
  misc_feature: GZ8MTXP01DZOKF.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgttgggttttcctcgttgctcttttaagaggtgtccagtgtcaagtgcaactggtggagtcgtgggggggcgtggtccagcctggggaggtccctgagactctcctgtgcaggctctggtattccacctcagtaactacggcgtgcacgtgggcccgccaggcctccgaggcaagggcttggagtggctggctagttgttcagtcgtaggaaggtaagttgttaacaattaactatacaacgtactccggtaggaaacgggcctattacacctatcctacaagacgaactaactaccaaagaacacgtaatcgtagtactagactaaagtcggaacacgacgtaagtagttaggaacggtaccgtaacgggttcttagtttattaacgttagggtaaacgggaagggagggggttattacggaaggtggaacagacttacgtaacgttcgtttaacg

SEQ ID NO: 351818 - DNA, 534 bp, Homo sapiens
  misc_feature: GZ8MTXP01ADYHS.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcacctcagtaactacggcgtgcactgggtcccgccaggctccaggcaagggcttggagtggctggcagttgttcatctagaaggagtgttaacaatctatacagactccgtgaacgggccgattcacatctccagagacaattaccaagaacacgatagtatctagacaaagtggacagacctaagagttgaggacacgggctagtttatacgttagtaacggaaaggagggggattacgaaggtgcgagcttactaagttaacttaacg

SEQ ID NO: 351819 - DNA, 638 bp, Homo sapiens
  misc_feature: GZ8MTXP01D5HFI.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggagtcgtggggggggcgtggtccagccgtgggaggtccctgagactctcctgtgcaggctctggattcacctcagtaactacggcgtgcacgtgggtcccgccaggctcgaggcaagggcttggagtggcgtggctagttgttcagtctaggaaggtatgtaacaataactatacagactccggtaggaaacgggtccgtattaccacctatcctaccaagtaacgaactaaacttaccgaaacgaaaccaacggtaattagttaactaccgttaaggaaccaaaagtacggaaacgaacggtaccgtaaaaggtagttacggaacggtaacgtacgggtaactttagtttaattaacgttaggtaaacgggaaaggggagggggttattaacggaaggtcggaacgagtaccttaccgtaacgttaacgtttaacg

SEQ ID NO: 351820 - DNA, 590 bp, Homo sapiens
  misc_feature: GZ8MTXP01ASRC7.8.38.D05.1.454.CMB.2.raw
  modified_base (492)..(492): a, c, t, g, unknown or other
  misc_feature (492)..(492): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggctggtccagccgtgggacgtccctgagactctctgtgcaggctctggattcacctcagtaactacggcgtgcacgtgggtcccgccaggcctccgaggcgaagggtcttggagtggctggctaggtttgtttcacgtcgtaggaaggtaagtgttaacaataactatacgagtacctccggtaggaaacgggtccgacttcacctatcctaccagaacgactaactaccaaacgaacaacgatagtatacgtagacaaagtagacagacgtaagngtagagacgtacggtcttagttattacgagtaaacggaaagggagggggttattacggaaggtgaacgacgaccgttacgtaagttaaccgtttaacg

SEQ ID NO: 351821 - DNA, 549 bp, Homo sapiens
  misc_feature: GZ8MTXP01CFYTX.8.38.D05.1.454.CMB.2.raw
  modified_base (392)..(392): a, c, t, g, unknown or other
  misc_feature (392)..(392): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagccgtgggagtccctgagactctcctgtgcaggctctggattcacctcagtaactacggcgtgcacgtgggtccgccaggctccgaggcaagggcttggagtggcgtggctagttgtttcacgtctgaaggtagtgttaacaatctatacagactcgagacggcatcacanctcagagacaatacaagaacacgatgtatctagacaaagtggacagacctaagagtaggagacgacggtcttgtttatacgttaggttaaacggaaggttagggggttattaacggaagtggaacgtagtaccgttacgtaacgttaacgtttaacg

SEQ ID NO: 351822 - DNA, 559 bp, Homo sapiens
  misc_feature: GZ8MTXP01DM3KR.8.38.D05.1.454.CMB.2.raw
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
  modified_base (526)..(526): a, c, t, g, unknown or other
  misc_feature (526)..(526): n is a, c, g, or t
  modified_base (536)..(536): a, c, t, g, unknown or other
  misc_feature (536)..(536): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcggtgggggggggctggtccagccgtggggacggtccctgagctctcctgtgcaggctctggattcacctnagtaactacggctgcacgtgggtcccncaggctccgaggcaagggcttggagtggctggctagttgttcatcgtagaaggtatgttaacaaattctatacagtacctccggtaggaaagggcccattcaccatctaccagaacgactaaattaccaaagaaaccagatacgtatactagacaaagtcggaacagacctaaagngttagagacacggtnttgtttatacgttagtaaaggaagggagggggnttacgtaagngcagcttactaagttcgttaacg

SEQ ID NO: 351823 - DNA, 529 bp, Homo sapiens
  misc_feature: GZ8MTXP01DOYX7.8.38.D05.1.454.CMB.2.raw
  modified_base (298)..(298): a, c, t, g, unknown or other
  misc_feature (298)..(298): n is a, c, g, or t
  modified_base (457)..(457): a, c, t, g, unknown or other
  misc_feature (457)..(457): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggagtccctgagactctcctgtgcaggctctggattcacctcagtaactacggcgtgcacgtgggtcccnccaggctccaggcaagggcttggagtggctggcagttgttcatctgaaggagtgttacaatcatacagactccgtgaagggccgattcacatctccagagacaattaccaagaacacgatgtatctgacaaatggacagacctaaagagttagaggacncggtctgttattacttaggtaaacggaaggagggggattacgaagtaggcagcttactaagttaacttaacg

SEQ ID NO: 351824 - DNA, 568 bp, Homo sapiens
  misc_feature: GZ8MTXP01ADJJE.8.38.D05.1.454.CMB.2.raw
  modified_base (298)..(298): a, c, t, g, unknown or other
  misc_feature (298)..(298): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactgggtggagtcgtggggggggctggtccagcctggggagtccctgagactctcctgtgcaggctctggattcacctcagtaactacggctgcacgtgggtcccnccaggctccgaggcgaagggcttggagtggcgtggctagttgttcatctagaaggtagtgttaacaatctatacgagaccgtccgtaggaaacgggccgacttacacctactctaccagaacgaactaataccaaagaacacgatagtatctagacaaagtagacagaccgtaagagttaggagacgaggtcttagtttaagttacgttaggtaaacgaaagggagggggattacgaagtggcaggcttaccgtaagttaacgtttaacg

SEQ ID NO: 351825 - DNA, 582 bp, Homo sapiens
  misc_feature: GZ8MTXP01C8GNM.8.38.D05.1.454.CMB.2.raw
  modified_base (300)..(300): a, c, t, g, unknown or other
  misc_feature (300)..(300): n is a, c, g, or t
  modified_base (423)..(423): a, c, t, g, unknown or other
  misc_feature (423)..(423): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactgggtggagtcgtggggggggctggtccagccgtgggacgtccctgagctctcctgtgcaggctctggattcacctcagtaactacggcgtgcacgtcgggtccnccaggcctccgaggcgaagggcttggagttggctggctagttgttcatcgtaggaaggtagttgtaacaaattaactataacaaggtacctccggtaggacgggccgattcacatctacaganactaataccaagaacacgatagtatctgaacaaagtgaacacgtacctaaagagttaggaggacgacggtcttagttattacgttaggtaaacggtaagggaacgggggttattacggaagtcgggtcaaggtccttacgtaacggttaactttaaccg

SEQ ID NO: 351826 - DNA, 588 bp, Homo sapiens
  misc_feature: GZ8MTXP01EE33V.8.38.D05.1.454.CMB.2.raw
  modified_base (299)..(299): a, c, t, g, unknown or other
  misc_feature (299)..(299): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggctggtccagcctgggagtccctgagactctcctgtgcaggctctggattcacctcagtaactacggcgtgcacgtcgggtcccnccaggcctccgaggcgaagggcttggagtggctggctagttgttcatctagaaggtagtgttaacaattaactataacagtacctccggtaggaaacgggccgattcaccatctccaagacgacaattaccaaagaacaacgatagtatcgtagacaaagtgaacagacctaaagtagttagaacggtacgacggtaacttagtttaagttacgttaggtaaacggaaagggttagggggattaacggaaggtcgggaactacggacttaccgtaagttaactttaacg

SEQ ID NO: 351827 - DNA, 646 bp, Homo sapiens
  misc_feature: GZ8MTXP01D7A4Z.8.38.D05.1.454.CMB.2.raw
  modified_base (152)..(152): a, c, t, g, unknown or other
  misc_feature (152)..(152): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (366)..(366): a, c, t, g, unknown or other
  misc_feature (366)..(366): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggcctcccagataccaccgganagattgtgttgacacagtctccagccacctgttctttgtctccgaaggggaaancgccaccctntcctgcagggccagtcagagttgttaacccacctagttacgcctaggtaaccaaacacaaacctcggaccaggcctcccacggcccctcatctttgatgcatccatcagggccacgtgcactcccagcctaggttcagtggcagtgggtntgggacagaacttcaactctactaccatcaagctacgcccgtagacgactagtaagtattttacgacttagtttacttacttgtacaaactacgttacggtaacgtacggtcgggcccggtcccgggggtccctaaccggtttccggacccgttacgggggaaacctaaaacgtttgaacggtaaactaaccgaaaacggtaacgttacgggtacggtcgttacggttccacctaacttccttcggtttccttccttacttccccgtttccccgtaaccc

SEQ ID NO: 351828 - DNA, 717 bp, Homo sapiens
  misc_feature: GZ8MTXP01CXHRP.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcggtggggggggctggtccagccgtgggacgtccctgagactctcctgtgcaggctctggattcacctcagtaactacggcgtgcactgtcgtccgcaggcctccgaggcaagggcttgggagtggctggctagtttcgtttccatcgtaggaaacggtagttagttacaagttactaataacgacgtactccggtaggaacgggccgtattcgacctagtcctaccgagacgactaaacgttaccaaacgaacaacgtaattacgggttaactaccgttacgaacgtaaagttacggaacgtaacggtaacccgttaaaggtacggtttaacggaacgggtaaccgtaaccgggttacctttaagggtttttaaacgtttacccggttaaaggggttaacccggggttaaaaaagggggttcgggggggttaaacttaaacggggtaacgggtttaacgggggaaccctacgggttacccgtttaacccgttaaacggtttttaaaccccgg

SEQ ID NO: 351829 - DNA, 740 bp, Homo sapiens
  misc_feature: GZ8MTXP01AXADB.8.38.D05.1.454.CMB.2.raw
  modified_base (306)..(306): a, c, t, g, unknown or other
  misc_feature (306)..(306): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtgggtggaggtcggtgggggggggctggtccaggccgtggggacgtccctgagctctcctgtgcaggctctggacttcacctcagtactacggcgtgcacgtgggtcccncgaggcctcgaggcaagggcttggagtggctggctagttgtttcatcgtagaaaggtagtgtaacaaatctaatacgagtaccgtccgtaggaaacggggtccctaacttcccaactactccgtaccgaacgaacgtaacctaaacttaacccgaaacgaaacccgtaacgtaacgttaggttaacttacgtacggtaaactaaacggttacggaaccaacggtacccgttaaaaggtaccgggtttagggaaacggggtaacccgtaacgggttaaccgtttaaagggtttttaaacgttaaacccggtttaaacgggttaaacggggaaaaacgggggttaacggggggttaagttaaacccggtaagggttacgggaaccgtaacggtacccgttaaaccgttaaaccgggtttaacttttaaacccgggg

SEQ ID NO: 351830 - DNA, 562 bp, Homo sapiens
  misc_feature: GZ8MTXP01C5D62.8.38.D05.1.454.CMB.2.raw
  modified_base (460)..(460): a, c, t, g, unknown or other
  misc_feature (460)..(460): n is a, c, g, or t
  modified_base (518)..(518): a, c, t, g, unknown or other
  misc_feature (518)..(518): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggctggtccagccgtggggaggtccctgagctctcctgtgcaggctctggattcacctcagtaactacggcgtgcacgtgggtcccgcgaggcctccgaggcaagggctggagtggctggctagttgttcatcgtagagtagtgtaacaatctatacgagtactcgtagacgggccgtattcactatcctaccaagagacaataccgaaagaacagatgtatctagacaaagtggacagacgtaagngtaggagacgagtcttgtttactacgttggtaaacggaaggggagggggattaacggnggtacggaacgtacggtaccttacgtaacgttaaccgtttaacg

SEQ ID NO: 351831 - DNA, 554 bp, Homo sapiens
  misc_feature: GZ8MTXP01CX0GA.8.38.D05.1.454.CMB.2.raw
  modified_base (297)..(297): a, c, t, g, unknown or other
  misc_feature (297)..(297): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcacctcagtaactacggcgtgcacgtgggtcccnccaggctccgaggcaagggctggagtggctggctagttgttcatctagaagtagtgtacaatctatacagactccgtagaacggccattcacatctaccaagagaacaattacccaaagaacacgatacgtatctagacaaatgaacagaccgtaaagtgttgagacacgggtcttggttattacgttagtaaacggaaggaagggggttacttacgtaaggtcgaacgacggcttaccgtaagttaacgtttaacg

SEQ ID NO: 351832 - DNA, 562 bp, Homo sapiens
  misc_feature: GZ8MTXP01DH4PT.8.38.D05.1.454.CMB.2.raw
  modified_base (176)..(176): a, c, t, g, unknown or other
  misc_feature (176)..(176): n is a, c, g, or t
  modified_base (270)..(270): a, c, t, g, unknown or other
  misc_feature (270)..(270): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtntccagtgtcaagtgcaactggtggagtcgtggggggggctggtccagccgtgggagtccctgagactctcctgtgcaggctctggattcacctnagtaactacggctgcacgtggtcccgcaggctccgaggcaagggcttggagtggctggctagttgttcatcgtagaagtatgtaacaatctatacagtactcgagacgggcatcacatcncaganactataccaagacacgtatgtatctagacaaagtcgacacgtactaaagtgttagaacggactcggtaacttagtttaacgttacgttaggtaaacgggaaaggggagggggttattaaccggaaggtacggcgacgtaccgttaccgtaacgttaacgtttaaccg

SEQ ID NO: 351833 - DNA, 541 bp, Homo sapiens
  misc_feature: GZ8MTXP01BJJZM.8.38.D05.1.454.CMB.2.raw
  modified_base (293)..(293): a, c, t, g, unknown or other
  misc_feature (293)..(293): n is a, c, g, or t
  modified_base (502)..(502): a, c, t, g, unknown or other
  misc_feature (502)..(502): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagactctcctgtgcaggctctggattcactcagtaactacggcgtgcactgggtccnccagggctccgaggcaagggcttggagtggctggcagttgttcatctagaaggtagtgtacaagtctatacagtactccggtagaacgggtccgattcacctatctccagagacaatcaagacacgatgtagtctagacaaagtgacagactaagtagttagaaggacgacggtcttgtttattacgttagtaacggaaaggagggggnttaggaacgaggtggcgagctaaccgttaaggttaaccg

SEQ ID NO: 351834 - DNA, 659 bp, Homo sapiens
  misc_feature: GZ8MTXP01DV9ON.8.38.D05.1.454.CMB.2.raw
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtgggtgggaggtcggtgggggggggcgtggtccagccgtgggagtccctgagctctcctgtgcagctntgnttcactcagtactacggcgtgcacgtcgggtcccgccgaggcctccgaggacaaggggtctttgggagtggcgttgggctagtttgtttacagttcgtaggaaggtagttagttaaccaaattctaataaccaggaccttccggtagggaaacgggtacccgattaccacctatccgtaccaagaacgaactaaactaccaaagaacaacgtaatagtaatacgttaggaactaaagtacggaacacgtaccgtaaagtacgttaggacggtaacgtacgggtaactttaggtttaacttaacgttagggtaaacggtaaaggggaagggggttattaacggtaaggtacggaacgtaacggccgttaaccgtaacgttaaccgtttaacgg

SEQ ID NO: 351835 - DNA, 534 bp, Homo sapiens
  misc_feature: GZ8MTXP01EXGQX.8.38.D05.1.454.CMB.2.raw
  modified_base (462)..(462): a, c, t, g, unknown or other
  misc_feature (462)..(462): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctggggaggtccctgagactctcctgtgcaggctctggattccacctcagtaactacggcgtgcacgtgggtccgccaggctccgaggcaagggcttgggagtggctggctagttgttcatcgtagaaggtatgtaacaatctatacagactccggtgaacgggccgatcaccatctcagacgacaactccaagaacacgatgtatctagacaaatgacagactaagagttgagacnggtcttgtttatacgttgtaaacggaagggagggggattacgaagtgcgagcttacctaagttaacttaacg

SEQ ID NO: 351836 - DNA, 585 bp, Homo sapiens
  misc_feature: GZ8MTXP01EVL90.8.38.D05.1.454.CMB.2.raw
  modified_base (299)..(299): a, c, t, g, unknown or other
  misc_feature (299)..(299): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggagtcggtggggggggctggtccagccgtggggacgtccctgagactctcctgtgcaggctctggattcacctcagtactacggctgcacgtggtccncaggctccgaggcgaagggcttggagtggctggctagttgttcatcgtagaaggtatgttaacaaatctataacacgtaccgtccggtaggaacgggtccgtattccacctatcctaccagaacgaactaacttacccaaagaacacgaatcgtaactctagaccaaagtcggaacacgacgtaaagagttaggacggacctacgggtctttagtttatacgttaggtaaacggaaagggagggggaacttagaaggtgcgagtccttactaagttaactttaacg

SEQ ID NO: 351837 - DNA, 549 bp, Homo sapiens
  misc_feature: GZ8MTXP01ED1WO.8.38.D05.1.454.CMB.2.raw
  modified_base (296)..(296): a, c, t, g, unknown or other
  misc_feature (296)..(296): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagctctcctgtgcaggctctggattcacctcagtaactacggcgtgcacgtgggtcccnccaggcctccgaggcgaagggcttggagtggctggctagttgttcatctagaaggatgttaacaataactataacagactccggtagaaacgggccgtattcaccatctaccaagaacgaactaaacttaccaaagaaacaacgaatgtaagtctagacaaagtggacagacctaaagagtgagacacggtctgtttatacgttggtaacgaaaggaggggattacgaagtgcagcttactaagttcttaacg

SEQ ID NO: 351838 - DNA, 556 bp, Homo sapiens
  misc_feature: GZ8MTXP01DSFH1.8.38.D05.1.454.CMB.2.raw
  modified_base (468)..(468): a, c, t, g, unknown or other
  misc_feature (468)..(468): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcggtggggggggcgtggtccagccgtgggaggtccctgagactctcctgtgcaggctctggattcacctcagtaactacggcgtgcacgtgggtcccgccaggctccgaggcaagggtctggagtggctggctagttgttcatctagaaggtagtgtaacaatctatacagtctaccgtgacgggctattcaccatctaccagacgacaattaccaaagaacacgatgtactactagaactaaagtggaacagtaccgtaaagngttagaggacaggtcttagtttatacgttagtaaacgaagggagggggacttacggaagtaggcaggacttacgtaagttctttaacg

SEQ ID NO: 351839 - DNA, 544 bp, Homo sapiens
  misc_feature: GZ8MTXP01EP0QB.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggagtcgtggggggggctggtccaggcctgggaggtccctgagactctcctgtgcaggctctggattcacctcagtaactacggcgtgcactgtgtcccgccaggctccgaggcaaggggcttgggagtggctggcagttgttccatctgaaggatgttacaatactatacagactccgtgaagggccgattcaccatctaccagacgacaattaccaaagaacaacgatagggtatctagacaaagtgacagacctaagtagttagaggacaacggtcttgttattacgtaggtaacgaaagggagggggagtaacgaggtgcgagctaacgttaagttaaccg

SEQ ID NO: 351840 - DNA, 564 bp, Homo sapiens
  misc_feature: GZ8MTXP01BO9SD.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcacctcagtaactacggcgtgcacgtgggtcccgccagggcctccgaggcgaaggggcttggagtggcgtggctagttgtttcattcaggaaaggaagttgttaacaaattaacgtataaccaggacctccggtaggaacgggccgtattcaccatcctccagtaacgactaactacaagaacacgatgtatctgacaaagtggacagacctaaagcgttagagacaggtcttagtttatacttagtaacggaaaggagggggattagaaggtggcgagtccttactaagttcgttaacg

SEQ ID NO: 351841 - DNA, 629 bp, Homo sapiens
  misc_feature: GZ8MTXP01COBA5.8.38.D05.1.454.CMB.2.raw
  modified_base (257)..(257): a, c, t, g, unknown or other
  misc_feature (257)..(257): n is a, c, g, or t
  modified_base (411)..(411): a, c, t, g, unknown or other
  misc_feature (411)..(411): n is a, c, g, or t
  modified_base (450)..(450): a, c, t, g, unknown or other
  misc_feature (450)..(450): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcggtggggggggctggtccagccgtggggacgtccctgagactctcctgtgcnggctcgtggattcacctcagtaactacggcgtgcacgtgtcgtcccgccaggcctccgaggcgaaggggtcttgggagtggctggctagtttgttccatgtggaaggtagtgttacaatactaatacagactccgtagaacgggctatccacanctacagagacaataccaagaacacgtatcggtatcgtanaacgaaagtcggaacaacgtaccgtaaaggtagttaggaacggtaacgtaacgggtctttaggtttaaacgttaccgttaaagggtaacgggttaaaagggggttaaggggggttacttaaaccggagggttaacgggaccgtacgggacccgttaaccgttaaacgggttttaacccg

SEQ ID NO: 351842 - DNA, 529 bp, Homo sapiens
  misc_feature: GZ8MTXP01A7VYW.8.38.D05.1.454.CMB.2.raw
  modified_base (299)..(299): a, c, t, g, unknown or other
  misc_feature (299)..(299): n is a, c, g, or t
  modified_base (458)..(458): a, c, t, g, unknown or other
  misc_feature (458)..(458): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcacctcagtaactacggcgtgcacgtgggtcccnccaggctccaggcaagggcttggagtggctggctagttgtttcatctgaaggagtgtacaatctatacagactcgtagaaggccgatcacatctcagacgacaactaccaagaacacgatagtatctagacaaataggacagacctaagagtgaggacncggctgtttattacgttgtaacggaaaggagggggattacgaaggtggcagcttaccgtaagttcttaacg

SEQ ID NO: 351843 - DNA, 582 bp, Homo sapiens
  misc_feature: GZ8MTXP01C3737.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggctggtccagcctgggagtccctgagctctcctgtgcaggctctggattccacctcagtaactacggcgtgcacgtcgggtcccgccaggcctccgagggccaagggcttggagtggctggctagtttgttcattctagaaggtatgttaacaattcgtatacagactcgagacggccgattcaccatctacagagacaataccaaagaacacgatagtactctagacaaagtcgaacagtaccgtaaagtagttaggaggacgtacggtctttagtttaagttacgttaggttaaacggaaagggttaagggggttacttaacggaaggtacggcgacgtaccgttacgtaacgttaacgtttaacg

SEQ ID NO: 351844 - DNA, 575 bp, Homo sapiens
  misc_feature: GZ8MTXP01BFFRW.8.38.D05.1.454.CMB.2.raw
  modified_base (477)..(477): a, c, t, g, unknown or other
  misc_feature (477)..(477): n is a, c, g, or t
  modified_base (495)..(495): a, c, t, g, unknown or other
  misc_feature (495)..(495): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggagtcggtggggggggcgtggtccagccgtgggagtccctgagctctcctgtgcaggctctggattcaccttcagtaactacggcgtgcacgtgggtcccgccagggcctccgaggcaaggggtcttggagtggctggctagtttgttacatcgtaggaaggtaagtgttaacaatctatacgagacctccggtagaaagggtccattcaccatcctacagacactaataccaaagaacacgtatgtatctagacaaagtgacagtacctaaaggngttggaacgacgacggtnttagtttatacgttaggtaaacggaaagggaggggttattacgaaggtgaacacgtcgttacctaagttaacgtttaacg

SEQ ID NO: 351845 - DNA, 683 bp, Homo sapiens
  misc_feature: GZ8MTXP01APRQ7.8.38.D05.1.454.CMB.2.raw
  modified_base (205)..(205): a, c, t, g, unknown or other
  misc_feature (205)..(205): n is a, c, g, or t
  modified_base (295)..(295): a, c, t, g, unknown or other
  misc_feature (295)..(295): n is a, c, g, or t
  modified_base (375)..(375): a, c, t, g, unknown or other
  misc_feature (375)..(375): n is a, c, g, or t
  modified_base (627)..(627): a, c, t, g, unknown or other
  misc_feature (627)..(627): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaanacgcccaccctctcctgcagggccagtcagagtcgttaccaccagttagcctggtaccaacacaaacctggccaggctcccaggcccctnatcttgatgcatccatcagggccactggcactcccagccgaggttcaggtggctaggtgggtctggggacagtaacttcnctctacaccatcagcacgccctagacgcctaggtaacgttatttttacggacttaaggttttacttacttacgtactaaacgtacgtaccggggtaaccggtaggttccgggccccggttcccgggggtcccttaccggtttcccggggaccccgttacggggtaaaccctaaaagtttcggaaacgtaaacgttaaccgaaaacgggtaaaccttgggtaacgggtccttacggaccttaaaccccgtttnttccgtttaaccgtttccctttaccgttacccgtttccccgttaacccccgtaacc

SEQ ID NO: 351846 - DNA, 564 bp, Homo sapiens
  misc_feature: GZ8MTXP01CVD0V.8.38.D05.1.454.CMB.2.raw
  modified_base (482)..(482): a, c, t, g, unknown or other
  misc_feature (482)..(482): n is a, c, g, or t
  modified_base (531)..(531): a, c, t, g, unknown or other
  misc_feature (531)..(531): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggaagtcgtggggggggcgtggtccagccgtgggacggtccctgagactctcctgtgcaggctctggtattcgacctcaagttaacctacgggcgtgccacgtcgggtcccgccagggcctcgacggcgaagggcttgggagtggcgtggcagtttgtttcagtcgtagaagtagtgttaacaatctatacagtactcgtggaaacgggcattacaccatcgtaccagagaactaactacaaagacagatgtactctagacaaagtggaacagacctaaaggnttaggacgacgtaggtcttagttatacgttagaaacggtagaagggggnttagaagtagcgagcttactaaggttcttaacg

SEQ ID NO: 351847 - DNA, 602 bp, Homo sapiens
  misc_feature: GZ8MTXP01BZ51P.8.38.D05.1.454.CMB.2.raw
  modified_base (547)..(547): a, c, t, g, unknown or other
  misc_feature (547)..(547): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctggggacggtccctgagctctcctgtgcaggctctggattcacctcagtaactacggcgtgcactgtgtcccgccaggctccagggcgaaggggcttgggagtggctggctagtttgtttccattcgtaggaaggtagttagttacaattactaatacacgtactccgggtaggaacgggcccgtattccgaacctactcctaccgaagacgaactaacttaccaaagaaccacgtataggtatctagacaaatggacagtaccgtaagtagtagaaggtcgaacggtctttgtttaagttacgtaggtaacggaaaggggngggggaattaacggaggttcggacgacgttaccgtaaccgttaacggtttaaccg

SEQ ID NO: 351848 - DNA, 648 bp, Homo sapiens
  misc_feature: GZ8MTXP01CPERL.8.38.D05.1.454.CMB.2.raw
  modified_base (308)..(308): a, c, t, g, unknown or other
  misc_feature (308)..(308): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtggggggggctggtccagccgtggggacggtccctgagactctcctgtgcaggctcgtggattccacctcaagtaactacggcgtgcacgtgggtcccncaggcctccgaggcgaagggctggagtggctggctagtttgtttcacttcgtaggaaggtagtgttaaccaattaacgtatacgagtaccgtccgtaggaacgggcccgattccaaccactctaccaagaacgaactaacttaccaaagaacaacgtatagtatactaggaaccaaagtcggaacacgtaccgtaaagtaggttaggaacggtaccgtacggtaacctttaaggtttaattaaacgttacggtaaaacggtaaggggaaggggggttattaaacccgggaaggtacggtaacaacggtccgttaaccgtaacgttaaccgttttaaccgg

SEQ ID NO: 351849 - DNA, 597 bp, Homo sapiens
  misc_feature: GZ8MTXP01CHA5O.8.38.D05.1.454.CMB.2.raw
  modified_base (307)..(307): a, c, t, g, unknown or other
  misc_feature (307)..(307): n is a, c, g, or t
  modified_base (524)..(524): a, c, t, g, unknown or other
  misc_feature (524)..(524): n is a, c, g, or t
  modified_base (554)..(554): a, c, t, g, unknown or other
  misc_feature (554)..(554): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaagtgcaacgtgggtggagtcggtggggggggctggtcgagccgtgggaggtccctgagctctctgtgcaggctcgtggacttcacctcagtaactacggcgtagcacgtcgggtcccncgaggcctccgaggcgaagggtctaggagtgcgtggctagtttgttcaatcgtaggaaggtaagtgttaaacaaattctaataacgaagtacccgttacggagggaacgggtaccctattccaactactcctaccgaagaacgtaaacctaaacttaccaaagaacaacgtagtagtatctagacaaagtgaacagactaagagtgacgacgacgtnttagttatacgttagaaaggaaggaggggnttacgaaggtcgaacgtacgccttacgtaacgttcgtttaacg

SEQ ID NO: 351850 - DNA, 623 bp, Homo sapiens
  misc_feature: GZ8MTXP01EDD2E.8.38.D05.1.454.CMB.2.raw
  modified_base (271)..(271): a, c, t, g, unknown or other
  misc_feature (271)..(271): n is a, c, g, or t
  modified_base (299)..(299): a, c, t, g, unknown or other
  misc_feature (299)..(299): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggctggtccagccgtgggagtccctgagctctcctgtgcaggctctggattccacctnaagtaactcggcgtgcacgtgggtcccnccgaggcctccgaggcgaaggggtcttggagttggctggctagttgtttacatcgtagaaggtagttgttaacaaatctaatacgaagtacctaccggtaggaacgggtcccgtattacacactctaccaagagaactaaactacaaagaaacaacgtatagtatcgtacgaacaaagtaggaaccagaccgtaaagaacggttaggaacggtacgtacggtaaccttagtttaacgttaacgttaaggtaaacggtaaagggttacgggggagttacggtaaggtggaacgtagtaccgttacgtaaacgttaacgtttaacg

SEQ ID NO: 351851 - DNA, 656 bp, Homo sapiens
  misc_feature: GZ8MTXP01CVWQG.8.38.D05.1.454.CMB.2.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccacggagagattgtgttgacacagtctccagccacctgtctttgctccgagggaangccacctncctgcagggccagtcagagtcgttaccaccagttacncctggtaaccaacacaaacctggccaggcctcccaggcccctnatctttagntcgactactactactacggacggacctacgtcgactaccctacccgacgaccggttacgttacgtacgggtcgtaccggtagggttccgggtacggtacggaacgtaacgttaaccctactaaccttaccacccgaacttacacgacgtacacgtaccgtaagaccgtacgtagtaacgtttagttacgtactttaagtttactacgtacgtactaaacgtacgtaccgggtaacgtcgggtaccgcccgggtacgggtcctacggttccggaccgtacggtaaacctagtcgaagtaactaacgaaagtgttggacgtcgttcacgttactgtctcgttctgttaccttcccgcgtaac

SEQ ID NO: 351852 - DNA, 602 bp, Homo sapiens
  misc_feature: GZ8MTXP01EPYQU.8.38.D05.1.454.CMB.2.raw
  modified_base (583)..(583): a, c, t, g, unknown or other
  misc_feature (583)..(583): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcgtggggggggcgtggtccagccgtgggacgtccctgagactctcctgtgcaggctcgtggacttccaccttcaagtaacctacggcgtgcacgtcgggtcccgccaggcctccgaggcgaagggtcttgggagtggcgtggctagtttgtttcagttcgtaggaaggtagtgttaacaaataactatacgagacctcggtaggaaacgggtccattcactatcctaccgaagaacgaactaaactaccgaaacgaacacgaagtcgtaactctaggaacaaagtacggaacagtaccgtaaagtagttaggaacggacgtacggtaatttagttaacgtagttaggtaaaggaagggaggggattagaagtgaacngacactaagttcgttaacg

SEQ ID NO: 351853 - DNA, 545 bp, Homo sapiens
  misc_feature: GZ8MTXP01ALXRQ.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcacctcagtaactacggcgtgcacgtgggtcccgccaggctccgaggcaaggggcttggagtggctggctagttgttcatctgaaggtatgttacaatctatacagactcgtagaaacgggccgattcaccatctccagacgacaatacccaagaacacgatagtactctagtacaaagtcggaacagacccgtaaagagttagacggacacggtcttagtttatacgttaggtaacggaaggagggggattacgaagtgcagcttactaagttcttaacg

SEQ ID NO: 351854 - DNA, 525 bp, Homo sapiens
  misc_feature: GZ8MTXP01A2F1Y.8.38.D05.1.454.CMB.2.raw
  modified_base (297)..(297): a, c, t, g, unknown or other
  misc_feature (297)..(297): n is a, c, g, or t
  modified_base (434)..(434): a, c, t, g, unknown or other
  misc_feature (434)..(434): n is a, c, g, or t
  modified_base (503)..(503): a, c, t, g, unknown or other
  misc_feature (503)..(503): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcacctcagtaactacggcgtgcactgggtcccnccaggcctccagtcaagggcttggagtggctggctagttgttcatctgaaggatgtacaatctatacagactccgtgaagggccattcacatctccagagacaattaccaagaacacgatgtatctgacaaatgganagactaagagttagaggacacggcttagtttatacttagtaacgaaaggagggggattacgaagtcggnagcttaccgaagttcgttaacg

SEQ ID NO: 351855 - DNA, 559 bp, Homo sapiens
  misc_feature: GZ8MTXP01AQEDB.8.38.D05.1.454.CMB.2.raw
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (466)..(466): a, c, t, g, unknown or other
  misc_feature (466)..(466): n is a, c, g, or t
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctggttttcctcgttgctcttttaagaggtgtccagtgtcaagtgcaacgtggtggagtcggtggggggggctggtccagcctggggacgtccctgagctctcctgtgcnggctctggatcactcagtaactcggcgtgcacgtgggtcccnccgaggcctaccgaggcgaagggcgttggagtggctggctagtttgttcatcgagaagtagtgttaacaaatctataacagtcgtaccgtggaaacgggtccgattcaaccatactaccgaagaacgaacaattacccaaagaacaacgtatagtatactagactaaagngaacagactaagngtagagacacgnttagttatacgagtaaggaaggagggggnttacgngtggaacacgacttacgtaacgttaacgtaacg

SEQ ID NO: 351856 - DNA, 617 bp, Homo sapiens
  misc_feature: GZ8MTXP01AX42L.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggaggtcgtggggggggcgtggtccagccgtgggacgtccctgagactctcctgtgcaggctcgtggacttcacctcaagtaactacggcgtgccacgtcgggtcccgccgaggcctaccgagggacgaagggggtcttagggagtggcgtggcgtagttgttcacttcgagaacggtattgttaacaaattaactaataacagtaccgtccggtaggaacgggtcacgttcacctactctaccagaacgactaaataccaaagaacacgtatacgtatctagaccaaagtcggaacagaccgtaaagaggttagaacggacgtacggtcgttagtttaattacgttaggttaaacggaaaggggttagggggattacggaaggtggcgtaacgtcttacgtaacgttcgttaacg

SEQ ID NO: 351857 - DNA, 624 bp, Homo sapiens
  misc_feature: GZ8MTXP01CIUY0.8.38.D05.1.454.CMB.2.raw
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (442)..(442): a, c, t, g, unknown or other
  misc_feature (442)..(442): n is a, c, g, or t
  modified_base (589)..(589): a, c, t, g, unknown or other
  misc_feature (589)..(589): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggaggtcggtggggggggggctggtccgagccgtgggacgtccctgagctctcctgtgcnggctngcttcactcagtaactcggcgtgcncgtgggtcccnccgaggcctcgaggcgaagggcttggagtggctggctagtttgttcattcgtaggaaggtattgttaacaatctatacagtactcgtaggaacgggctagttcaaccattccaccgagaacgaactaaacttacccgaaanaaaccgtacgtattacggttaactcgttaacggaacctaaagttacggacccgaagtacccgttaaaggaggttacgacgggtaacctaacgggtctttaaggtttactaacggttaggttaaacggaaggggaggggttacttagnggacggctaacgcgttacgtaagttccgtttaacg

SEQ ID NO: 351858 - DNA, 688 bp, Homo sapiens
  misc_feature: GZ8MTXP01BCDKM.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcggtggggggggctggtccaggccgtggggacggtccctgagtactctcctggtgcaggctcgtggacttcaccttcaagtaactacggcgtgcacgtcgggtcccgcaggctccgaggcgaagggcttggagtggcgtggctagtttcgttcagtcgtaggaaggtaagttcgttaacaaagttctagtaccgaaggtaccgttccgggtaaggaaacgggtccccgtattccaaccctaacgtcctaaccgaggtaacgaacctaacttaacccgaaagaacctaacgtattacggtaactcgtaggtaacaaacgtacggaaccgacgtaaccgtaaaggtagttcggaagggtaccgaccggttaatttaacggttttaaacgtacggttaaggtaaaccgggtaaaggggacgggggttaacttaccggaaggttcgggaacctaggtaccgttacgtaaaacgtttccgtttaaccgg

SEQ ID NO: 351859 - DNA, 611 bp, Homo sapiens
  misc_feature: GZ8MTXP01C4ADZ.8.38.D05.1.454.CMB.2.raw
  modified_base (577)..(577): a, c, t, g, unknown or other
  misc_feature (577)..(577): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggtttttcctcgttgctcttttaagaggtgtccagtgtcaagtgcaacgtggtggaggtcggtggggggggctggtccagccgtgggagtccctgagctctctgtgcaggctctggtattcacctcagtaacgtacggcgtgccacgtggtcccgcaggcctcgaggcaagggctggagtggctggctagttgtttacatcgtagaaggtaagttgttaaacaataacgtaatacgacgactccggaggaaacggccgtattccaaccactcctaccgaagaacgaactaaacttaccaaagaacgaactaatagttacttgtacgaacctaaagtcggaaacacgtaccgtaaaggagttaggacggtaccgtaggtaacttagtttacgttacgttaggtaaacggaagggttaagggggattacggnggtagcgacgtacttaccgtaagttcgtttaacg

SEQ ID NO: 351860 - DNA, 673 bp, Homo sapiens
  misc_feature: GZ8MTXP01A54BB.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtgggggggggctggtccagccgtgggaggtccctgagctctcctgtgcaggctctggattcacctcagtaactcggctgcactgtgtccgccaggctccgaggcaagggcttgggagtggctggctagtttcgtttccagtctaggaaaggtagttgttacaattactaatacagaccttccggaggaacgggccgtattccaccatcctacgaagacgaaactaattacccaaagaacaacgtacttagggtaactacgttagaaccgtaaagtacggaaaccctaggtaacccgttaaaggtagggtttaggaacgggtaacgtaaccgggttaccgtttaaggttttaaacgtttaacccggtaagggttaaaaccggggttaaaagggggttaacggggggggttaattaaccgggagggttcggacgtaagacccgttaacccgttaaagttttaaaccccg

SEQ ID NO: 351861 - DNA, 599 bp, Homo sapiens
  misc_feature: GZ8MTXP01DTMY7.8.38.D05.1.454.CMB.2.raw
  modified_base (297)..(297): a, c, t, g, unknown or other
  misc_feature (297)..(297): n is a, c, g, or t
  modified_base (348)..(348): a, c, t, g, unknown or other
  misc_feature (348)..(348): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (398)..(399): a, c, t, g, unknown or other
  misc_feature (398)..(399): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggtttttcctcgttgcttctttttaagaggtgtccagtgtcaagtgcaacgtggtggagtcggtggggggggctggtccagccgtgggacggtccctgagactcctcctgtgcaggctctggacttcacctcagtaactacggcgtgcncgtcggcccgcaggctcgaggcgaagggcttggagtcggcgtggctagttnttcatctagaaggtatgtaacaatctanacagactcgngacggcatcacnnctacagagacaatacaagaacagactagtactactagaactaaagtcggaacaacgtaccgtaaaggtgttaaggacggtacgtacggtaacgttaagtttaagttaacgttacggtaaaacggtaaagggggttaagggggacttaaacgggaaggtacgggaacgacgtacgttacccgtaaaggttaactttaaccg

SEQ ID NO: 351862 - DNA, 604 bp, Homo sapiens
  misc_feature: GZ8MTXP01B6F8R.8.38.D05.1.454.CMB.2.raw
  modified_base (257)..(257): a, c, t, g, unknown or other
  misc_feature (257)..(257): n is a, c, g, or t
  modified_base (306)..(306): a, c, t, g, unknown or other
  misc_feature (306)..(306): n is a, c, g, or t
  modified_base (514)..(514): a, c, t, g, unknown or other
  misc_feature (514)..(514): n is a, c, g, or t
  modified_base (523)..(523): a, c, t, g, unknown or other
  misc_feature (523)..(523): n is a, c, g, or t
  modified_base (571)..(571): a, c, t, g, unknown or other
  misc_feature (571)..(571): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactgggtggagtcggtggggggggcgtggtccagccgtggggaggtccctgagactctcctgngcaggctctggattcacctcagtaactacggcgtgcacgtcgggtcccnccgaggcctccgagggcaagggcgttgggagtggctgggctaggtttgttcattcgtaggaaaggtattgttaacaaagttaactataaacgagtaccgtaccgggtaggaacggggacccgtattaccacctactctaccaagaacgaactaaacttaccaaagaaacacgtatacgtatactagacaaagtggaacagactaaagngtagagacnggtaacttgtttaatacgttaggtaaaggaagggagggggacttaggnggtgaacagtacttactaacgttaacgttaacg

SEQ ID NO: 351863 - DNA, 630 bp, Homo sapiens
  misc_feature: GZ8MTXP01BWLI1.8.38.D05.1.454.CMB.2.raw
  modified_base (315)..(315): a, c, t, g, unknown or other
  misc_feature (315)..(315): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggtttttcctcgttgcttcttttaagaggtgtccagtgtcaagtgcaacgtgggtggaggtcggtgggggggggctggtccaggccgtggggacggtccctgagactctcctgtgcaggctcgtggtacttcaccttcagtaacctacggctgcacgtcgggtcccnccgaggcctccgaggcgaagggcttggagtggctggctagttgttcatctagaaggtatgtaacaaatcgtatacagacctccggaggaacggccgtacttaccgacctacgtctaccagaacgactaaactaccgaaagaaactacggtaattacgtaactcgttacggaaaccaaaggtacggaacgaacgtaaccgtaaaggtacggttaaggaacggtacgtaacgggtaacttagtttactaacgttaggtaaacggaagggttagggggattacgaaggtgaactagcgttacctaagttcctttaacg

SEQ ID NO: 351864 - DNA, 625 bp, Homo sapiens
  misc_feature: GZ8MTXP01D1ZBN.8.38.D05.1.454.CMB.2.raw
  modified_base (306)..(306): a, c, t, g, unknown or other
  misc_feature (306)..(306): n is a, c, g, or t
  modified_base (574)..(574): a, c, t, g, unknown or other
  misc_feature (574)..(574): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggagtcgtggggggcgtggtccagcctgggagtccctgagactctcctgtgcaggctcgtggtacttcaccttcaacgtaactacgggcgtcgcacgtgggtcccnccagggcctcgaggtccgaaaggggtcttgggagtggcgtggctagttgttcagtcgtaggaaggtattgttaacaattaactataccgagtacgtccgtaggacgggcctattaccacatctacagaacgaactaatacccgaaagaacacgtaatgtaactcgtagactaaagtcggaacacgtaccgtaaaggtcgttaggaacggtacgacgtaacgtttagtttagtaacgttaaggtaaacggtaaagggttaagggggttnttaaacggtaaggttaggctaacggtcttaccgttaacgttcgttttaacg

SEQ ID NO: 351865 - DNA, 591 bp, Homo sapiens
  misc_feature: GZ8MTXP01DSOWC.8.38.D05.1.454.CMB.2.raw
  modified_base (305)..(305): a, c, t, g, unknown or other
  misc_feature (305)..(305): n is a, c, g, or t
  modified_base (377)..(377): a, c, t, g, unknown or other
  misc_feature (377)..(377): n is a, c, g, or t
  modified_base (404)..(404): a, c, t, g, unknown or other
  misc_feature (404)..(404): n is a, c, g, or t
tcagctcgcgtgtccacgaccggtgctcgatttagtatctgatagttgagctctgggagaggagcccagcactagaagtcggcggtgtttccattcggtgatcagcactgaacatagaggactcaccatggagtttgggctgagcttgggttttcctcgttgcttcttttaagaggtgtccagtgtcaagtgcaacgtggtggagtcgtggggggctggtccagcctgggacgtccctgagactctcctgtgcaggctcgtggtacttcaccttcaagtaactacggcgtgctacgtcgggtccnccgaggctccgaggcaaggggtcttggagtggcgtggctagttgttcatcgtagagtagtgtaacaatctanacagactcgtaggacggccgattcacntctaccagagactaataccgaagaacacgatgtaactcgtagaacaaagtggaacacgtactaaaggtagttaggacgtacgtacggtaactttgtttaacgtacgttaggtaaagggaaagggttagggggttacttacggtaaggtacggaacgtacgacgttacgtaacgttaaccgtttaacg

SEQ ID NO: 351866 - DNA, 701 bp, Homo sapiens
  misc_feature: GZ8MTXP01BO29L.8.38.D05.1.454.CMB.2.raw
  modified_base (295)..(295): a, c, t, g, unknown or other
  misc_feature (295)..(295): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctggggaggtccctgagatctcctgtgcagctctggattcactcagtaactacggcgtgcacgtgggtccnccaggcctcgaggcgaaggggcttggagtggctggtctagttgttcatcgtaggaaggagtgtaacaataactatacgagaccgtaccggtaggaacgggtccgacttaccacctactacctaccaaggtaacgaactaacttacccgaaagtaaaccgaacggtaattacggttaactacgtaacggtaaccgaaaagttacgggaacctaacggtacccgttaaaagggtaggtttaacgggaaacggggtaaccgaaccggggttaactttaacgggttttaaacgtttaaccggttaagggtaaaccggggtaaaagggggttaacgggggggttattaaccgggtaagggttcgggaacgtacggtaccgttacccgtaacggttaaccgttttaacccgg

SEQ ID NO: 351867 - DNA, 572 bp, Homo sapiens
  misc_feature: GZ8MTXP01A9906.8.38.D05.1.454.CMB.2.raw
  modified_base (277)..(277): a, c, t, g, unknown or other
  misc_feature (277)..(277): n is a, c, g, or t
  modified_base (463)..(463): a, c, t, g, unknown or other
  misc_feature (463)..(463): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (515)..(515): a, c, t, g, unknown or other
  misc_feature (515)..(515): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggctggtccagccgtggggagtccctgagactctcctgtgcaggctcgtggtattcaccttnaagtaactacggcgtgcacgtcgggtcccgcaggctccgaggcgaagggcttggagtggctggctagtttgttcagtctaggaagtatgttacaatctaatacagactcggtagaacgggtcccattcaccatcctacagaacgacaacttacaaacgaacacgtatcgtatcagacaaagtcganagacgtaagtgtagaggcncggtnttgtttagtacgaggtaaaggaaagggngggggttaattacggaagggtcgaacgtacgtaccttacgtaacgttaacgttaacg

SEQ ID NO: 351868 - DNA, 623 bp, Homo sapiens
  misc_feature: GZ8MTXP01BJBBK.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaagtgcaactggtggagtcgtggggggggctggtccagcctgggagtccctgagactctcctgtgcagtctctgattcacctcagtactacggcgtgcacgtggcccgccaggcctccgaggcaagggcttggagtggctggctagttgttcatcgtagaaggtagtgtaacaattaactataccagtacgtccgtaggaaacgggtccacttcacctactacctaccaagactaactaaacttaccaaagaaccaacgtatagttaagtctaggaccaaagtaggaacctacggacctaaaggtacgttaggaggaacgtaccggtaacttaggttttaaataccgttaggtaaaccgggaaaggggttacggggggttacttacggaaggtacggaaccgaggtaccttaaccgtaaccggttaattttaaccgg

SEQ ID NO: 351869 - DNA, 617 bp, Homo sapiens
  misc_feature: GZ8MTXP01E2ZQX.8.38.D05.1.454.CMB.2.raw
  modified_base (302)..(302): a, c, t, g, unknown or other
  misc_feature (302)..(302): n is a, c, g, or t
  modified_base (379)..(379): a, c, t, g, unknown or other
  misc_feature (379)..(379): n is a, c, g, or t
tcagctcgcgtgtccacgaccggtgctcgatttagtatctgatagttgagctctggggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggagtcgtggggggggctggtccagcctgggagtccctgagactctcctgtgcaggctctggattcacctcagtaacgtacggtgtgcctacgtgggtcccnccgaggcctccgaggcaagggtctggagtggctggctagttgttcatcgtagaaaggaagtgttaacaattaactanacagtactccggtaggaacgggtccgtacttacacctatctaccgagaacgaactaaattacccgaaagaaaccacgtaattagtaacttctagaccaaagtcggaacgaacgtaccgtaaaggtagttagaacgggactaacggtcttagttttaagttacgttagggtaaacggaaagggaagggggttacttaacgtaaggtggcgtaacggcttacgtaacggttctttaaccg

SEQ ID NO: 351870 - DNA, 586 bp, Homo sapiens
  misc_feature: GZ8MTXP01AY2ZZ.8.38.D05.1.454.CMB.2.raw
  modified_base (353)..(353): a, c, t, g, unknown or other
  misc_feature (353)..(353): n is a, c, g, or t
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggctggtccagccgtggggagtccctgagactctcctgtgcaggctctggattcacctcagtaactacggcgtgcacgtcgggtcccgccgagggcctccgaggccgaaggggtcgttgggagtggctggctaggttnttcatcgtagaagtagtgttaacaatctatacagacctcggtagacgggtccgattccaccgatctaccgagacgaactaataccaagaacacgtatagtatctagacaagtgacagacctaaagngtagacggtacncggtnttagttatacgttaggtaaacggaaagggttagggggattacggtaaggtcggaacgtacggtacttaagtaaccgttaacgtttaacgg

SEQ ID NO: 351871 - DNA, 617 bp, Homo sapiens
  misc_feature: GZ8MTXP01CXUV4.8.38.D05.1.454.CMB.2.raw
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttggggttttcctcgttgcttcttttaagaggtgtccagtgtcaagtgcaacgtggtggaggtcggtgggggggggcgtggtccaggccgtgggacggtccctgagactctcctgtgcaggctcgtggattcacctnagtaactcggcgtgcacgtcgggtcccnccgaggcctccgaggacgaagggtcttgggaggtggcgtggctagttgttcatcgtaggaggtagtgttaacaatctataccagtacgtccgagacgggaccgtacttcacctatcctaccgaagacgtaactaacttacccaaagaaccaggtacttagtaactctagaacctaaggtacgaacgacgaccgttaaagtcgttaggaacggtacgacggttcgtttaagttacgttaacggttaggtaaacgggtaagggagggggttacagtaaggtgcaggtcttaccgtaagttcgtttaacg

SEQ ID NO: 351872 - DNA, 602 bp, Homo sapiens
  misc_feature: GZ8MTXP01CS74G.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggaggtcggtgggggggggctggtccaggccgtggggacggtcccctgacgactctcctgtgcaggctctggattcacctcagtaactacggcgtgcacgtcgggtccgccaggctccgaggcaagggcttggagtggctggctagttgttcatcgtaggaagtagtgttaacaatctatacagtacgtccgtagacgggccagttcacctatcctaccgaagacgaactaacttaccgaaagaacacgtatagtatctagaacaaagtgaacagaccgtaagtagttaggaggacgtacggtcttagtttaactacgttacggtaaacgggtaaagggacgggggttacttaccggaaggtaggcgacggtacttaccgtaacgttaaccgtttaaccgg

SEQ ID NO: 351873 - DNA, 683 bp, Homo sapiens
  misc_feature: GZ8MTXP01AXK2U.8.38.D05.1.454.CMB.2.raw
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagcctgggagtcanagagactctctgtgcagcctcgtggttcacctnagtagctacggcatgcacgtcgggtcccaccaaaacgtccgaagggacaagggggtatttagggggaggtgggggtacgtcgtaggtttgttcattcgtggagggtctaggtgttacaagtggtatgcgtgacggcgtaggaacggctattcacctagtcctaccagtacgaccaaaccgtaccgaacggtaaacaacgtaagttacggtttaacgtttacgggaaccccttaaggaaacccgtacggtacccgttaaaacggttcccgtaagggtaacggtaaccggtacggggtaattaacgttacgtaacggttacgggtaaacgggaacgggggacgggggaaccgacgggtaaccgggtaggttaacccgaaggttaccgttaccgttaacggaaccggttccgggg

SEQ ID NO: 351874 - DNA, 618 bp, Homo sapiens
  misc_feature: GZ8MTXP01AGQZ6.8.38.D05.1.454.CMB.2.raw
  modified_base (315)..(315): a, c, t, g, unknown or other
  misc_feature (315)..(315): n is a, c, g, or t
  modified_base (448)..(448): a, c, t, g, unknown or other
  misc_feature (448)..(448): n is a, c, g, or t
  modified_base (531)..(531): a, c, t, g, unknown or other
  misc_feature (531)..(531): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactgggtggaggtcggtgggggggggctggtccagccgtggggacgtccctgagactctcctgtgcaggctcgtggtacttccacctcaagtaaccgtacggcgtgccacgtcgggtcccnccgaggcctccgaggcgaaggggtcttgggagtggctggctaggtttgttcagttcgtagaaggtagttgtaacaataactataccgagtacctacggtaggaaacgtaccgtatccacctatcctaccaganaactaactaccaaagtaacacgtattcgtatcgtagacgaaagtcggaacagtaaccgtaaggacgtggaacggactacggtnttagtttaatacgttaggtaacggaaaggggagggggttacttacggaaggttcggctacgaccgttacgtaacgttcgtttaacgg

SEQ ID NO: 351875 - DNA, 570 bp, Homo sapiens
  misc_feature: GZ8MTXP01AR6PW.8.38.D05.1.454.CMB.2.raw
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (491)..(491): a, c, t, g, unknown or other
  misc_feature (491)..(491): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggaggtcggtggggggggctggtccagccgtggggacgtccctgacgactctcctgtgcaggctctggatcacctnagtaacncggctgcacgtgggtcccncaggcctccgaggcgaagggtcttggagtggctggctagttgttcatcgtaggaaggtatgttaacaatctatacgagacctcggtaggacgggctattccaccatcctaccaagacactaattcaaagacagatagactctagactaagtcggactagtagtaaggtagttggaacgtacgtacggtnttagtttatacgaggtaaacggaagggaggggacttacggaaggtggaacacggtccttactaacggttaactttaacg

SEQ ID NO: 351876 - DNA, 718 bp, Homo sapiens
  misc_feature: GZ8MTXP01ARQFB.8.38.D05.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanacgccaccctctcctgcagggccagtcagagtgttaccaccagttagcctggtaccaacacaaacctggccaggctcccaggcccctnatctttgatgctcactcacgacgactgcgactccacgacgacgttacgtacgtggtcgcggtaggggtcggttagggacgacgacgttaacctacctctccacccactcacgacacgacctacgacgcctagtaagtaagttttgttacgtaacgttttaagtttaacttcggttactaaacctaacgttacccggttaacccggggtacggttaccggggtccccgggttcccggggggtaccccgttaacccgtttcccggggttccccggtaaccgggtaaacgtaaaacgttacggtaacggaaacctaacgtaaaacccggttaaacgttacgggttagggacccgttaaggcccgttaaccacggttaaccttcgttaacctttaccgtacttacccggtttcccccgttaacccgtaacc

SEQ ID NO: 351877 - DNA, 586 bp, Homo sapiens
  misc_feature: GZ8MTXP01CWAY9.8.38.D05.1.454.CMB.2.raw
  modified_base (302)..(302): a, c, t, g, unknown or other
  misc_feature (302)..(302): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtgggggggggcgtggtccagccgtggggacggtccctgagactctcctgtgcaggctctggattcacctcagtactacggcgtgcacgtgggtccnccaggctccgaggcgaagggcttgggagtggctggctagtttgttcatcgtgaaggtaatgttaacaattctatacacgtactccggtagaacgggcctacttcaccgatcctaccagacgacaaacttaccaaacgtaacaacgattgtaactctagacaaagtcggaacacgactaagagttagacggtacaggtcttagttaattacgttaggtaaacggaaagggagggggttacttacggaaggtagcgtaggaccttacgtaacgttaacgtttaacg

SEQ ID NO: 351878 - DNA, 753 bp, Homo sapiens
  misc_feature: GZ8MTXP01EZB6V.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctggattttcctcgttgctcttttaagaggtgtccagtgtcaagtgcaactggtggagtcgtggggggggctggtccagccgtgggaggtccctgagactctcctgtgcaggctctggattcaccttcaagtaactacggcgtgcctacgtcgggtcccgccgaggcctccgagggcaagggggcttgggagtggctgggctagtttgtttaccagttcgaggtaaaggtaagttaagtttaaactaacttaagtaaaccgtaaggtaacccgtttcccggggtaggaaaccgggggtcccggtaactttaccaccctaacgtcctacccgtaaggaaacggtaaactaaacgttaacccaaacggtaaaccaaaccggtaacttaaggttaacgttacgtacggtaaaccaaacgttggggaaaccagtaccccgtaaaggtacggttaggtaacgggaaccgtaacgggtaaccgttaagttttaacgttaaaccgttacgggttaaacgggtaaaaggggaacgggggggttaaattacccggttaagggtacgggtaaccgtaacgacccggttaacctaaaccgggtttaaccgttttaaccgg

SEQ ID NO: 351879 - DNA, 574 bp, Homo sapiens
  misc_feature: GZ8MTXP01CZ5UJ.8.38.D05.1.454.CMB.2.raw
  modified_base (475)..(475): a, c, t, g, unknown or other
  misc_feature (475)..(475): n is a, c, g, or t
  modified_base (494)..(494): a, c, t, g, unknown or other
  misc_feature (494)..(494): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtgggtggagtcggtgggggggggctggtccagccgtggggacgtccctgagctctcctgtgcaggctctggattcacctcagtaactacggcgtgccacgtcgggtcccgccaggcctccgaggcgaagggcttgggagtggctggctagtttgttcatcgtagaggtatgtaacaatctatacagactcgagaacgggcctattcacctatctaccagagaactaatacccaaagaacacgatagtatctagacaaagtggaacagtaccgtaaagngttaggagtacgtacggtnttagtttatacgttaggtaaacggaagggagggggattacgaaggtcggcacggtcttaccgtaagttaactttaaccgg

SEQ ID NO: 351880 - DNA, 632 bp, Homo sapiens
  misc_feature: GZ8MTXP01BZI12.8.38.D05.1.454.CMB.2.raw
  modified_base (179)..(179): a, c, t, g, unknown or other
  misc_feature (179)..(179): n is a, c, g, or t
  modified_base (327)..(327): a, c, t, g, unknown or other
  misc_feature (327)..(327): n is a, c, g, or t
  modified_base (587)..(587): a, c, t, g, unknown or other
  misc_feature (587)..(587): n is a, c, g, or t
  modified_base (600)..(600): a, c, t, g, unknown or other
  misc_feature (600)..(600): n is a, c, g, or t
tcagctcgcgtgtccacgaccggtgctcgatttagtatctgatagttgagctctggggagaggagcccagcactagaagtcggcggtgtttccattcggtgatcagcactgaacacagaggactcaccatggagtttgggcttagcttgggttttcctcgttgcttcttttaagaggtntccagtgtcaagtgcaacgtggtggaggtcggtggggggggctggtccagccgtgggacgtccctgacgctctcctgtgcgaggtctcgtggtacttccaccctttagacgttaaaccgtcgggcgtgacctaccggtcggggtcccnccgaggcctccgaggccgaagggtcttgggagtggctgggtctagtttgtcagtctaggaaggtaagttgtacaaatactaatacgacgaccttacggtagaacgggcctattaccacctattccacagaacgaactaacttaccaaagtaaccacgatagtactacgtagaactaaagtcggaacacgtacgtaaagagttacggaagtaccgagtcgttaagttaattacggtagaaacggtaaaggggaggggttanacggttgtcggancgtactacttacggttaacttaacgtttaacg

SEQ ID NO: 351881 - DNA, 596 bp, Homo sapiens
  misc_feature: GZ8MTXP01CPQYB.8.38.D05.1.454.CMB.2.raw
  modified_base (301)..(301): a, c, t, g, unknown or other
  misc_feature (301)..(301): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtgggtggagtcggtggggggggctggtccagccgtgggagtccctgagactctcctgtgcaggctctggattcacctcagtaactacggcgtgcacgtgggtcccnccaggcctccgaggccgaagggtctggagtggctggctagttgttcactctagaaggtagtgtaacaatctatacgagacctcgtagaacgggccgattccacatctaccagacgaacaacttaccaaagaacaacgatagtatctagacaaagtgaacacgactaaagcgttagagtacgacggtaacttagttagttacgttaggttaaaccgggaaagggttaggggggttacttaccggtaaggtaggaaccgtaacgggtccttaaccgtaacggttaacctttaaccgg

SEQ ID NO: 351882 - DNA, 716 bp, Homo sapiens
  misc_feature: GZ8MTXP01BKR9M.8.38.D05.1.454.CMB.2.raw
  modified_base (208)..(208): a, c, t, g, unknown or other
  misc_feature (208)..(208): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcggnggggggggctggtccaggccgtggggaggtcccctgacgactctcctgtgcaggctctggattcacctcagtaactcggctgccacgtcgggtcccgccgaggtcctccgaggaccgaagggggtcgttgggagtggccttagggctagtttgttcagtcgtagaaaggtagttgttaacaataactactaacgagtacccgttacggagggaacggggccctatttaccaaccgtactaccgtacccaaggtaacgaactaaacttacccgaaacgaaacgacgtaagttaggtaacttacgttagtaaccgtaaaagtacggaaaccgtaacgtaacccgtaaacggtaggttaacgggaacggtaaccgtaacgggtccgtttaagttttaaggttaaaccgttaaggggttaaacgggaaaggggttaaagggggttaaccgttaacggaagggtaacgggtaacaacggttcccttaccgtaaacggttaacgttttaaccgg

SEQ ID NO: 351883 - DNA, 636 bp, Homo sapiens
  misc_feature: GZ8MTXP01BX75A.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtgggtggagtcggtggggggggctggtccagccgtggggacggtccctgagactctcctggtgcaggctcgtggacttcacccttcgaagtaaccgtacggctgcacgtcgggtcccgccaggcctaccgaggcgaagggtcttgggagtggcgtggcgtagtttgttcatcgtaggaaggtagtgtaacaataactatacgagtaccgtcggtaggaaacgggcctacttcgaccactactaccaagaacgaactaaacttaccgaaacgaaacacggtaatagtatcgtagacaaagtagacgaggacctaaaggtagtaggacgacgtacggtcgttagtttaacgttaacgttaggtaaacgggaaagggagggggttacgttacggtaaggtcggaacgtacgtaccgttaccgtaacggttaactttaaccgg

SEQ ID NO: 351884 - DNA, 665 bp, Homo sapiens
  misc_feature: GZ8MTXP01EU8WS.8.38.D05.1.454.CMB.2.raw
  modified_base (382)..(382): a, c, t, g, unknown or other
  misc_feature (382)..(382): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggagtccctgagactctcctgtgctacggctcgtggactttccgacctacagtaacctcggctcgtaccgtacgggtccgcccgtacggtaccgtacggacggtacggacggtcggtcggtaggtcggtcgtcggtcgtagtttcgttctacgntagtagtaagtaagtacgtaaactaactaactactacgtacgtacgtacgtacggtacgacgtactactacactactacaacgtaacgaactaactaacaacgactaacgtactagtacgtacgtacgaacgtaacgaacgacgaacgtaacgtaacgtacgtacggtacgtacgtacgtaacgttaacgttaacgttaacgttaacggtaaacgggtaagggaagggttacggacgtaacggtacgtaacgtacgtaccgttacgtaacgttaacgttaacg

SEQ ID NO: 351885 - DNA, 605 bp, Homo sapiens
  misc_feature: GZ8MTXP01EV6LK.8.38.D05.1.454.CMB.2.raw
  modified_base (274)..(274): a, c, t, g, unknown or other
  misc_feature (274)..(274): n is a, c, g, or t
  modified_base (522)..(522): a, c, t, g, unknown or other
  misc_feature (522)..(522): n is a, c, g, or t
  modified_base (563)..(563): a, c, t, g, unknown or other
  misc_feature (563)..(563): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaagtgcaacgtggtggagtcggtggggggggctggtccagccgtgggaggtccctgagctctctgtgcaggctctggattcacctnagtaactacggcgtgcacgtgggtcccgccaggctccgaggcgaagggcttgggagtggcgtggctagtttgttcattcgtaggaaggtagtcgttaacaaattaacgtataacgacgtacgtccggtaggaacgggtccgtactacaccatccacaagaacgactaaacttaccgaaagaacaacgtaattgtactctagactaaagtcgaacacgaccgtaaaggtacgtaggacgacgtacggtntttagttaatacgttaggaaaggtaaaggggaagggggttnttacggaaggtcggaacacgcgttactaagttaacgttaacg

SEQ ID NO: 351886 - DNA, 740 bp, Homo sapiens
  misc_feature: GZ8MTXP01B9QLF.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcggtgggggggcgtggtccagccgtgggacgtccctgagctctcctgtgcaggctctggattcacctcagtaactacggcgtgcacgtcgggtccgccgaggcctcgaggcgaagggtcttggagtggctggctagttgttcactcgtagaaggtagtgttaacaagtaactataacgagtactaccggtaggaacgggtacccgtacttaccgaaccctactaccgtacccaaaggtaaacgaactaaacttaacccgaaaaggaaaaccaaccggtaattaggttaacgttacgtaacggtaaacccaaaaggttacggaaaccgaacggtaacccggttaaaaggtaaggtttaacgggaacgggtaaaccggtaaccgggttaacctttaaaggttttaacgtttaaaccggttaaggggttaaaaccgggtaaaagggggttaaacggggggggttaattaaaccgggtaagggttacgggtaaccgaacggggtaccttacccgtaaaaggtttaacccttttaaccggg

SEQ ID NO: 351887 - DNA, 556 bp, Homo sapiens
  misc_feature: GZ8MTXP01B5Z0O.8.38.D05.1.454.CMB.2.raw
  modified_base (297)..(297): a, c, t, g, unknown or other
  misc_feature (297)..(297): n is a, c, g, or t
  modified_base (519)..(519): a, c, t, g, unknown or other
  misc_feature (519)..(519): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggagtcgtgggggggctggtccagcctgggaggtccctgagactctcctgtgcaggctctggattcactcagtaactacggcgtgcacgtgggtccncagggcctcgagggcaaggggcttgggagtggctggcctaggtttgttcatctgaagtatgtacaaagtctatacagactcggtagaacggccgattcacatctccagacgacaattaccaaagaacacgatagtactctagaacaagtagacagtacctaaaggagttaggaagacgacggtcttagtttagttacgttagtaacggaaggagggggttanacggaagtgggaacaggcttactaacgttcgttaacg

SEQ ID NO: 351888 - DNA, 960 bp, Homo sapiens
  misc_feature: GZ8MTXP01BBWSH.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggagtcggtggggggggctggtccagccgtgggacgtccctgacgctctctgtgcaggctcgtggtacttcacccttacaggtaacctacgggccgtgccgaccggttcggggtccccgacccgacgggtcctacccggagggaccggtaaagggggtccttttagggggacggttcgggggtaccgttcggggtaccgttaagggttttcggttttaccaacgtttaccggttaagggtaaaacggggtaaaggttttcggtttaaacctaaaaactttccttaaaagtacccgaaaccgggtaacccgtttacccccggggtaagggtaaaaccgggggttaccccggtaacgtttacccgtaaacccctaacgttacccgttaacccgaaacggtaaaccggtaaacctaaaacctttaaaccccgaaaaaccggtaaaaccgaaacccgggtaaagtttaacggtttaaaccttacccgttaaacggggtaaaccctaaaaaaggtttaccgggtaaaccgaaaccggttaaccccggtttaaaacgggttaaacgggtttaagggaaaccggggtaaacccggttaacgggggtttaacccgttttaaagggttttttaaacgtttaaaccggttaacggggttaaaacgggggtaaaacggggttaaggggggggttaacttaaaccgggtaagggttacgggaacgtaaccggtaccgttaacccgttaaaacggtttaaccgttttaaccgg

SEQ ID NO: 351889 - DNA, 528 bp, Homo sapiens
  misc_feature: GZ8MTXP01AZP8J.8.38.D05.1.454.CMB.2.raw
  modified_base (156)..(156): a, c, t, g, unknown or other
  misc_feature (156)..(156): n is a, c, g, or t
  modified_base (247)..(247): a, c, t, g, unknown or other
  misc_feature (247)..(247): n is a, c, g, or t
  modified_base (291)..(291): a, c, t, g, unknown or other
  misc_feature (291)..(291): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggtttccncgttgctctttaagaggtgtccagtgtcaagtgcaactggtggagtcgtgggggggctggtccagcctgggagtccctgagctctcctgtncaggctctggattcactcagtaactcggctcgcacgtgggcccncgaggcctccgaggccaaggggtcttgggagttggactggactgttgttcatctagagtactgtaacaatcagtacagactcgtagaaggtccattcacgntcacgagacacatacgaanacatatatagntaganacgagacgacgacgtaagagtagagacgagtaagtagttacgtagttagtaaggaagggagggagacgaagagcgacgtacttactaacgttaacgtaacg

SEQ ID NO: 351890 - DNA, 554 bp, Homo sapiens
  misc_feature: GZ8MTXP01C5GJO.8.38.D05.1.454.CMB.2.raw
  modified_base (308)..(308): a, c, t, g, unknown or other
  misc_feature (308)..(308): n is a, c, g, or t
  modified_base (380)..(380): a, c, t, g, unknown or other
  misc_feature (380)..(380): n is a, c, g, or t
  modified_base (436)..(436): a, c, t, g, unknown or other
  misc_feature (436)..(436): n is a, c, g, or t
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
  modified_base (501)..(501): a, c, t, g, unknown or other
  misc_feature (501)..(501): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaaggaggtgtccagtgtacaagtgcaacgtgggtggaggtcggtgggggggggctggtccaggccgtggggacggtccctgagactctcctgtgcaggctctggattcacctcagtaacacggctgcacgtgggcccnccaggcctcgaggcaagggtcttggagtggctggctagtttgttcatcgtagaaggtattgtaacaatctanaacagacgtccgaggaacgcctattcactatctacaagagaactaactaccgaaanaacacgatagtatacgtagacaaagtgaacngactaagngtagagtacnggtcttagttatacgngtaaacggaagggaggggattacgaagtgctaggcttacgtaagttcgttaag

SEQ ID NO: 351891 - DNA, 678 bp, Homo sapiens
  misc_feature: GZ8MTXP01A69WM.8.38.D05.1.454.CMB.2.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (295)..(295): a, c, t, g, unknown or other
  misc_feature (295)..(295): n is a, c, g, or t
  modified_base (658)..(658): a, c, t, g, unknown or other
  misc_feature (658)..(658): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccacctgtctttgctccgaggggaaangccaccctntcctgcagggccagtcagagtcgttaccacctagttacgcctaggtaccaacacaaacctggccaggcctcccgacggcccctntattctttgatgcatccatccgagggcccacgtggaccactcccgaagcctaggttcaggtcggacgtaggttcggggtacgtggggaacctaggtaacctttccaacttctaccaacctatccgagcacgaccctaaggacgtcctaggtaaacgttgtttttacggactttaaggttttacttaacgtgtaacctaaacgtacgttaaccggggtaccggtacgggtccggccccgggttccgggggacccttacggtttccgggaccccgtagggtaaaccctaaaagttcggaataacgtaacttaaacggacttcgggtcgccgttacgccttacctaacttcgttcgttccttaccncgttccccgttcccgaaccg

SEQ ID NO: 351892 - DNA, 631 bp, Homo sapiens
  misc_feature: GZ8MTXP01BT6UZ.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaagtgcaacgtggtggaggtcggtggggggggcgtggtccaggccgtggggaggtccctgagctctcctgtgccaggctcgtggacttcaccttcagtactacggcgtgcacgtcgggtcccgccgaggctacccgagggaccgaaggggtctttgggaggttggcgttaggctagtttgtttcacttcgtagaagggtagttgtaaacaataacgtataacagtaccgtccggtaggaacgggcctatccacactctcagacaactaacgtacaaacgacacatagtactacgtagacaaagtggaacaggtacctaaggacgttaggacggtaccgtagtcgtttagtttaacgttagttacgggtaaacgggaaagggttagggggttattacggtaagggtcggtaacacgtaccttacgtaaccgttaacgtttaacg

SEQ ID NO: 351893 - DNA, 690 bp, Homo sapiens
  misc_feature: GZ8MTXP01A1LU3.8.38.D05.1.454.CMB.2.raw
  modified_base (600)..(600): a, c, t, g, unknown or other
  misc_feature (600)..(600): n is a, c, g, or t
tcagctcgcgtgtccacgaccggtgctcgatttagtatctgatagttgagctctgggagaggagcccagcactagaagtcggcggtgtttccattcggtgatcagcactgaacacagagactcaccatggagtttgggctgagtcttgggttttcctcgttgtcttcttttaagaggtgtccagtgtcaagtgcaacgtgggtggaggtcggtggggggggcgtggtccgagccgtggggacgtccctgagactctccgtgtcgcaggctctggtattcctacctacgaacgtaaccgtacggcgtcgctaccggtcgggtcccgccgacggcctaccgaggacggaagggtcgttgggagtggtcgtggtcctaggtttcgtttcgagttcgtaggaaaggtaagttcgttaaacaaagttaactaactacgaacgtaccgtcgggtaagggaacgggtccctacttaccgaacctacgttaccgacccgaaaggtaaaccaactaaacgttacccgaaaagaaactacgtaagttacgtactacgtagaacctaaagtcggaaccaggtacctaaaggtcgtaggaacggtcacggtnttagtttacgtacgaaggtaaacggaagggttaggggttattacgtaagggtcggaactacggtccttaacgttaacgttaactttaacg

SEQ ID NO: 351894 - DNA, 609 bp, Homo sapiens
  misc_feature: GZ8MTXP01DKNWY.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagtctgggtttttcctcgttgcttcttttaagaggtgtccagtgtcaagtgcaacgtggtggagtcggtggggggggcgtggtccagccgtggggaggtccctgagacctctccgtgtgcaggctctggtacttcaccctacagtaaccgtacggcgtgcctacgtcgggtcccgcccgaggcctccgaggcgtaaagggtcttggagtcggcgtggctagttgttcatcgtaggaaaggtagtgttaacaattcaatacagaccgtccggtagaaacgggccattcaccgatcgtacaagaacgaactaaacttaccaaagaaccgaacgtattacgtaatctagaactaaagtcggaacagacgttaaagtgttaggaaggtacgtcggtcttaagtttattaacgttagtaaacggaagggaggggattacgaagtggaacagcttactaagttaacgttaacg

SEQ ID NO: 351895 - DNA, 596 bp, Homo sapiens
  misc_feature: GZ8MTXP01B7CQD.8.38.D05.1.454.CMB.2.raw
  modified_base (300)..(300): a, c, t, g, unknown or other
  misc_feature (300)..(300): n is a, c, g, or t
  modified_base (516)..(516): a, c, t, g, unknown or other
  misc_feature (516)..(516): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctggggagtccctgagactctcctgtgcaggctctggattcacctcagtaactacggcgtgccacgtcgggtcccnccgaggcctccgaggcaaggggcttggagtggctggctagttgttcatcgtagtaaggtaagtgttaacaatctaataccaggtacctacccggtaggaaacgggcccgtacttccaacctactccgtaccaaggaacaaactaacttaccgaaagaaacacgaatgtaactcgtagacctaaagtgaacacgaccgtaagagttgagactcggtnttagtttagtacgttggtaaacggaagggagggggttattacggaagcggtaacacgtcttacgtaacgttcgtttaacg

SEQ ID NO: 351896 - DNA, 590 bp, Homo sapiens
  misc_feature: GZ8MTXP01A147Q.8.38.D05.1.454.CMB.2.raw
  modified_base (277)..(277): a, c, t, g, unknown or other
  misc_feature (277)..(277): n is a, c, g, or t
  modified_base (502)..(502): a, c, t, g, unknown or other
  misc_feature (502)..(502): n is a, c, g, or t
  modified_base (568)..(568): a, c, t, g, unknown or other
  misc_feature (568)..(568): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggaggtcggtggggggggcgtggtccagccgtgggagtccctgagactctccgtgtgcgaggctctggattccacctnaacgtaacgtcggcgtgcacgtcggtcccgcacggcctccgaggccgaagggtcttgggagtggctggctagttgttcatcgtagaaggtagtgttaacaatctaatacgagtaccgtccggtagaacgggcccgtatcaccatcacagacaactaactacaagacagtatacgtagtcgagacaagtaggacacgacctaaaggtgttaggacggacgacggtnttacgttaaagtacgttagtaaacgggaaagggttacgggggaattacggaaggtggaacgacgtnttaccctaagttaacgttaacg

SEQ ID NO: 351897 - DNA, 705 bp, Homo sapiens
  misc_feature: GZ8MTXP01C0CH6.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggtttttcctcgttgcttcttttaagaggtgtccagtgtcaagtgcaactggtggagtcggtggggggggcgtggtccagccgtgggaggtccctgagctctctgtgcaggctctggatcacctcagtacgtacggcgtgctacgtcgggtcccgccgaggcctccgaggcgaaggggtcttggagtggcgtggcttagttgttcacttcgtaggaaaggtagttgttaacaaattaacgtaatacgaacgtaccgtccggtaggaacgggccgtattaccgacctagtcctccgaagaacgaacgtaaacttacccgaaaagtaaccgaacgtagttacgttaaattcccgtaaggaacctaaaggttaccggaaccgtaacgtacccgttaaaaaggtcgggtttaacggaaacgggtacccgtaacgggttctttaacgggttttaacgttaaccggttagggttaaaaccgggaaagggggttaacgggggttattaacggtaacggtgggtaaccgagtacccgttaaccgtaagttaaccgtttttaaccgg

SEQ ID NO: 351898 - DNA, 603 bp, Homo sapiens
  misc_feature: GZ8MTXP01DKR8P.8.38.D05.1.454.CMB.2.raw
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactgggtggagtcggtggggggggcgtggtccagccgtgggacgtcctgagactctctgngcaggctctggattcacctcagtaactacggcgtgcacgtcgggtcccnccgaggctaccgaggacgaaggggtcttgggaggtggcgtggtccgtaggtttcgtttcacgttacgtaggaacggtaagttcgttaaacaaacttaactaataacaagtaccgtccggtaggtaaacggggccctaattccaccgtatcctaccgaagaacgaactaactaccaaagtaaacagtatgtatctagaactaagtcgaacagacctaaaggtagttagagactaggtctttagtttaatacgttagtaaacggaagggagggcagaaggtagcagcttacgtaagttctaacg

SEQ ID NO: 351899 - DNA, 621 bp, Homo sapiens
  misc_feature: GZ8MTXP01BFMRV.8.38.D05.1.454.CMB.2.raw
  modified_base (304)..(304): a, c, t, g, unknown or other
  misc_feature (304)..(304): n is a, c, g, or t
  modified_base (588)..(588): a, c, t, g, unknown or other
  misc_feature (588)..(588): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccgagccgtggggacggtccctgagactctccgtgtgcaggctctggacttcacctcagtaactcggcgtgcacgtcgggtcccncgaggctccgaggtcaaggggtcttggagtggtcgtggtctaaggtttgtttaccagtttcgaggtaaacgggtaagtgttaaaccaattaacttacgtaccgaagtacgttcccgtagggaaacgggccctaattccaccagttccgaccagaacgactaataccgaaaggaaccataagtgtacgtacgtacgtaacgtaacgacgacgacgacgtaagtagtagacgacgtacgtaacgttagttagtacgttacggtaacggtaaggagggacgttacgngtgtcgacgacgttacgtaacgttaacgtaacg

SEQ ID NO: 351900 - DNA, 780 bp, Homo sapiens
  misc_feature: GZ8MTXP01BQKDR.8.38.D05.1.454.CMB.2.raw
  modified_base (306)..(306): a, c, t, g, unknown or other
  misc_feature (306)..(306): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggacggtccctgagactctcctgtgcaggctcgtggattccacctcagtaactacggcgtgccgtacgtcgggtcccnccgaggcctaccgaggccgaaggggtcgttagggacgtggccgtgggccttaggtttacgtttcgaacgttccggtaggtaaaggggtaagttcgtttaaacaaacgtttaaccgtaataaacccgtaaagtacccgttaccgggtacgggaaacggggtcccgtacgtttaccgaacctaactcccgtaccgaacggtaacgtaaacctaaacttacccgaaaacgaaaccgtaacgtaacgttaggttaacttaacgtaggaaccgtaaaagttacggaaaccgacggttaacccgttaaagggtacgtttaacgggaacgggtaaaccgtaaccgggttaaccgtttaaggttttaaacgtttaaaccggttaggtaaaccggggtaaaagggttaaggggggttacttaccgggtaaggttacgggaaccgtacgggtaccttaccggtaacgttaaccgttttaaccgg

SEQ ID NO: 351901 - DNA, 536 bp, Homo sapiens
  misc_feature: GZ8MTXP01CHMQX.8.38.D05.1.454.CMB.2.raw
  modified_base (411)..(411): a, c, t, g, unknown or other
  misc_feature (411)..(411): n is a, c, g, or t
  modified_base (480)..(480): a, c, t, g, unknown or other
  misc_feature (480)..(480): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggaggtcggtggggggggcgtggtccagccgtgggaggtccctgagactctcctgtgcaggctctggattcacctcagtaactacggcgtgcacgtcgggtccgccaggcctccgaggcaagggtcttggagtggctggctaggttgtttcatctggaagtagttgtaacaatctatacagactcgtagaacggctatcaccatctcaganaacaatacaagaacacgatgtactctagacaaagtgaacagactaagagtgagacagtctgttatacgngtaaacggaaggagggggattacgaaggtgaacgagtcacctaagttcgtttaacg

SEQ ID NO: 351902 - DNA, 717 bp, Homo sapiens
  misc_feature: GZ8MTXP01EL9RD.8.38.D05.1.454.CMB.2.raw
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggcgtggtccagccgtgggagtccctgagctctcctgtgcaggctcgtggtacttccaccttcaagtaactacggcgtgcacgtcgggtcccncgaggcctcgaggcgaagggtcgttgggagtggctgggctagttnttcatctaggaaggattgtaacaatctatacgacgtacctaccgggtagaacggggtccctattacacctactacctaccgaaggtaacgaaacttaaacttaccgaaacgaaacctaacgtaagttacggtaactttaccgtaagaaccgtaaaagttaccgggaaactaacggtaaccgtaaaaggaccggtttaagggaaaccgggtaaccgtaaccgggttaacgtttaggttttaaacgttaaccggttaaagggtaaaccgggtaaaagggggttaaggggggttaacttaaaccggaagggttacggccgtaacggtacccgttaccgtaaaacggttttaacccgtttaaaccggg

SEQ ID NO: 351903 - DNA, 612 bp, Homo sapiens
  misc_feature: GZ8MTXP01B6FXJ.8.38.D05.1.454.CMB.2.raw
  modified_base (276)..(276): a, c, t, g, unknown or other
  misc_feature (276)..(276): n is a, c, g, or t
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (443)..(443): a, c, t, g, unknown or other
  misc_feature (443)..(443): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaagtgcaacgtgggtggagtcggtggggggggctggtccagccgtgggacggtccctgagactctcctgtgcaggctcgtggattcactnagtaactcggctgcacgtcgggtcccgccaggcctcgaggcgaagggcttgggagtgcgtggctagttnttacatcgtagaagtagtntaacaatntatacagtactccgaggaacgggcctatacacctatctaccaaggtacaactaacttaccaaagaacctanaatgtagtctagacaaagtacggaacaacggtacctaaaggagttacggaacgggtacaccggtcgttaacgttttacgttaacggttagggtaaacggtaaaggggaaggggggttattacggaaggtagggaacacggcgttaaccctaaggttaacctttaaccgg

SEQ ID NO: 351904 - DNA, 732 bp, Homo sapiens
  misc_feature: GZ8MTXP01B26YZ.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggaggtcggtggggggggctggtccagccgtgggagtccctgagctctcctgtgcaggctgtggattccacctcaagtaactacggcgtagcacgtcgggtcccgccgaggcctccgaggacgaagggtcgttgggagtggcgtggcctaggtttcgtttacattcgtaggtaaagggtaagtgttaaacaaagttcctaataacgacgtacgtcccgggtaaggaaacgggtcccgtattccaacctactcctaccaagaacgaacgtaaattaacccgaaaggtaaaccaacgtaatacggttaactacgttaacggaacctaaaagtcgggaaacctaacggtacccgttaaaagggtaggttacgggaaacggtaccgtaaccggggtaactttaaggtttaaacgttaaccggttaagggttaaaccgggaaaagggggttaaggggggttaaacttaaccgggtaacgggttaggggaacctaacgggtacccttaaccggtaaacggtttaaccgttttaacccgg

SEQ ID NO: 351905 - DNA, 597 bp, Homo sapiens
  misc_feature: GZ8MTXP01DGEKI.8.38.D05.1.454.CMB.2.raw
  modified_base (487)..(487): a, c, t, g, unknown or other
  misc_feature (487)..(487): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagtcttgggttttcctcgttgtcttcttttaagaggtgtccagtgtcaagtgcaacgtggtggagtcggtggggggggcgtggtccaggccgtgggacggtccctgagctctcctgtgcaggctctggtatcacctcagtaactacggcgtgcacgtcggtccgcaggctcgaggacgaagggtcgttggaggtggctggctagttgttcgatcgtagaaggtatgtaaacataactatacacgactccgtagaacgggcctattcactatcctccaagaacgactaactaccgaaagaacacgatacgtaacgtctagaacaaagtcgaactacgacgtaaagngttagaacgtacgccgtaattagttacttaacggttaggaaaggtaagggttaaggggacttaaggaaggtacgtaacgacggtccttaacgtaacgttcccgttttaag

SEQ ID NO: 351906 - DNA, 726 bp, Homo sapiens
  misc_feature: GZ8MTXP01C4CPV.8.38.D05.1.454.CMB.2.raw
  modified_base (681)..(681): a, c, t, g, unknown or other
  misc_feature (681)..(681): n is a, c, g, or t
  modified_base (695)..(695): a, c, t, g, unknown or other
  misc_feature (695)..(695): n is a, c, g, or t
tcagctcgcgtgtccacgaccggtgctcgatttagtatctgatagttgagctctggggagaggagcccagcactagaagtcggcggtgtttccattcggtgatcagcactgaacacagaggactcaccatggagtttgggctgagtcttgggttttcctcgttgtcttcttttaaggaggtgtccagtgtcaagtgcaacgtggtggagtcggtggggggggctggtccagccgtgggacggtccctgacgtactctcctgtcgcaggctcgtggtacttcacctcgaagtaacctacgggcgtcgcctacggtggtcccgccacggctaccgaggacgaagggcgttggaggtggcgtggctaggtttcgttcagttcgtaaggtaaggtaacgtttcggtaaacctaaattaacgttaaacgtaacgtaaacggtaccgttccgggtaacgggtaaacgggtcccgtaacttaccaacctacgtccttaccgaacgaacggtaacctaaacgtttacccgaaacgttaaaccgaacgtaaagttacggttaacttaccgttagaaacgtaaacgtacggaaaccgtacgaccgttaaaggtagttacggaacggtacgtaacggtaacgttaagtttaacgttacgttagggtaaacggtaagggttaacgggggttanacggtaagtacggngtaacgacttacgtaagttaacgtttaaccg

SEQ ID NO: 351907 - DNA, 710 bp, Homo sapiens
  misc_feature: GZ8MTXP01CKZCH.8.38.D05.1.454.CMB.2.raw
  modified_base (211)..(211): a, c, t, g, unknown or other
  misc_feature (211)..(211): n is a, c, g, or t
  modified_base (262)..(262): a, c, t, g, unknown or other
  misc_feature (262)..(262): n is a, c, g, or t
  modified_base (315)..(315): a, c, t, g, unknown or other
  misc_feature (315)..(315): n is a, c, g, or t
  modified_base (407)..(407): a, c, t, g, unknown or other
  misc_feature (407)..(407): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgacaacgtggtggagtcggnggggggggctggtccaggccgtggggacgtccctgagtactctcctgtgcngtctcgtggacttccaccgtcaagttaacgtcggcgtgccacgtcgggtcccnccaggtcctccggaggcaacgggcgttaggagtcggcgtggcctagtttcgttcagttcgtagaaggtatcttaacgtaataactataacgngtaccgtccgggtggaaacgggtccctacttccgaacctactcctacccgaagaacgaaacctaaacgttacccgaaacgtaaaccgacgtaagtaacggttacttacgtaagtaaccgtaaacgtacgggtaaccgaaacgtaccgttaaaaggacgtttaacgggaacgtaaccgtacggtaaccgtttagtttaacgttaaacgttacgggtaaacggggtaaaggggttacgggggttaacgaacgtaagggtccggaacgtacgggtacttaccgttaaacggttaaccgtttaaccg

SEQ ID NO: 351908 - DNA, 554 bp, Homo sapiens
  misc_feature: GZ8MTXP01E2Z0M.8.38.D05.1.454.CMB.2.raw
  modified_base (428)..(428): a, c, t, g, unknown or other
  misc_feature (428)..(428): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcacctcaagtaactacggcgtgcacgtgggtccgccaggctccaggcgaagggcttggagtggctggctagttgttcatctagaaggtaatcgttaacaatctatacagactccgtgaaagggccatcaccatctcagagacaatccaaagactacgatgtanctgacaaagagacgacgacgtaagagttagaggacgacggtcgtgtttattagttagtaacggtaaaggaagggggaggttacgtaagtggaacgacgacgttacctaacggttaacgtttaaccg

SEQ ID NO: 351909 - DNA, 541 bp, Homo sapiens
  misc_feature: GZ8MTXP02HLCRF.8.38.D05.1.454.CMB.2.raw
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (418)..(418): a, c, t, g, unknown or other
  misc_feature (418)..(418): n is a, c, g, or t
  modified_base (445)..(445): a, c, t, g, unknown or other
  misc_feature (445)..(445): n is a, c, g, or t
  modified_base (518)..(518): a, c, t, g, unknown or other
  misc_feature (518)..(518): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttccgcgttaggctcttttaagaggtgtccagtgtcaagtgcaactggtggagtcgtggggggggctggtccagcctgggaggtccctgagactctcctgtgcaggctctggattcacccttnagtactacggcgtgcacgtcgggccnccgaggcctccgaggacgaaggggtcttgggagtggctggctaggtttgttcagtcgtaggaaggtagttgtacaatctatacagtacctcggtagaacgggccatcaccatcacaganacaatacaagacacatagtatctaganaagtagacgacgacgtaagagtagagacgacgtacgtagttattacgtagtaacggaaggagggtagagaagngacgacgactactacgtactacg

SEQ ID NO: 351910 - DNA, 518 bp, Homo sapiens
  misc_feature: GZ8MTXP02G8S3Q.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggagtgttcaatctatacagactccgtgaagggccgattcaccgtctccagagacaatcaaagaacacgatagtatctgacaaatggacagacctaagagttagaggacacggctacgttattactgtacgaaaggagggggatacgagtggcagctacaagtactactttag

SEQ ID NO: 351911 - DNA, 600 bp, Homo sapiens
  misc_feature: GZ8MTXP02JP0JF.8.38.D05.1.454.CMB.2.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (358)..(358): a, c, t, g, unknown or other
  misc_feature (358)..(358): n is a, c, g, or t
tcagctcgcgtgtccacgaccggtgctcgatttagtatctgatagttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtcgttaccaccagttagcctggtaccaacacaaacctggccaggcctcccaggcccctnatctttgatgcatccatcgaggccacgtggcatcccagccaggttcagtggcaggtggtctgggacngtaccttcactctacaccatcagcagcctagacgtcctagaagtacttttgaccttagttttaacttactgtacctaaactattccggtaaccggaggtcgggcccggtaccgggggtcctacgtttccgggcccgtaggggaaccctaaaagttcgaagtaactacgaaaacgtaacgtggtacggctacggaccctaacgaacttccgttacgtacctttccacttcccgtttcccgacc

SEQ ID NO: 351912 - DNA, 527 bp, Homo sapiens
  misc_feature: GZ8MTXP02J2E4J.8.38.D05.1.454.CMB.2.raw
  modified_base (369)..(369): a, c, t, g, unknown or other
  misc_feature (369)..(369): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttggctgagctgggttttcctcgttgctcttttaagaggtgtccagtgtcaagtgcaactggtggagtcgtggggggggcgtggtccagcctgggaggtccctgagctctcctgtgcaggctctgattcaccttcagtaactacggcgtgcactgggtcccgccaggcctccagggcaagggcttgggagtggctggcagtttgtttcatctgaagagttgttacaatctatacngactccgtgaagggccgattcaccatctccagagacaattaccaagaaacaacgatgtatctgacaaatggacagacctaagagttgaggacacggcttgtttattactagtaacgaaaggagggggatacgaagtggcacgctaccaagtacttacg

SEQ ID NO: 351913 - DNA, 523 bp, Homo sapiens
  misc_feature: GZ8MTXP02JMW3R.8.38.D05.1.454.CMB.2.raw
  modified_base (296)..(296): a, c, t, g, unknown or other
  misc_feature (296)..(296): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagactctcctgtgcaggctctggattcaccttcagtaactacggcgtgcactgggtccnccaggcctccaggccaagggcttggagtggctggcagttgttcatctgaagagtgtcaatctatacagactccgtgaagggccgatcacatctcagagacaattaccaagaacacgatagtatctagacaaagtagaacagacctaagagttagaggacgacggtactagttattactagtaacggaaagagggggatagaagtggacacgctacaacgtacttacg

SEQ ID NO: 351914 - DNA, 546 bp, Homo sapiens
  misc_feature: GZ8MTXP02GDYHX.8.38.D05.1.454.CMB.2.raw
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (369)..(369): a, c, t, g, unknown or other
  misc_feature (369)..(369): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagctctcctgtgcaggctctggattcaccttcagtaactacggcgtgcacgtgggtccnccaggcctccgaggccaagggcttggagtggctggctagttntttcatcgtagaaggagtgttacaatctanacagacctccgtagaacgggccgatcaccatctccagacgacaataccaagaacacgatagtatctagacaaagtgaacagacctaagagttagaaggtacgacggtactagtttattacgtaggtaacgaaagggacgggggatacgaagtcgacgacgctacaacgtacttaacg

SEQ ID NO: 351915 - DNA, 514 bp, Homo sapiens
  misc_feature: GZ8MTXP02FVF6T.8.38.D05.1.454.CMB.2.raw
  modified_base (387)..(387): a, c, t, g, unknown or other
  misc_feature (387)..(387): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccaggctccgaggcaagggcttggagtggcgtggcagttgtttcatctgaagagtgttcaatctatacagactcgtagaggcatcacanctcagagacaatcaagaacacgatgtatctgacaatgacagactaagagtgaggacgacggtactagtttattacgtagtaacggtaaggacggggatagaagtggacagcgtacaacgtacttacg

SEQ ID NO: 351916 - DNA, 535 bp, Homo sapiens
  misc_feature: GZ8MTXP02JDXO3.8.38.D05.1.454.CMB.2.raw
  modified_base (395)..(395): a, c, t, g, unknown or other
  misc_feature (395)..(395): n is a, c, g, or t
  modified_base (416)..(416): a, c, t, g, unknown or other
  misc_feature (416)..(416): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttcctcgttagctctttaagaggtgtccagtgtcaagtgcaactggtggagtcgtggggggctggtccagccgtgggaggtccctgagactctcctgtgcaggctctggattcaccttcagtaactacggcgtgcacgtcgggtccgccaggctccaggcaaggggcttggagtggctggctagttgttcatctagaagatgtacaatctatacagactcgtgaaggccatcaccatctccaganacaataccaagaacagaattntatctagacaagagacagacgtaagagtaggacgacgacggtacttagtttatacgtaggtaaacggtaaagggacggggaatacgaaggtcgacgacgtactacgtaacgtacttacg

SEQ ID NO: 351917 - DNA, 528 bp, Homo sapiens
  misc_feature: GZ8MTXP02HL1DH.8.38.D05.1.454.CMB.2.raw
  modified_base (369)..(369): a, c, t, g, unknown or other
  misc_feature (369)..(369): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (441)..(441): a, c, t, g, unknown or other
  misc_feature (441)..(441): n is a, c, g, or t
  modified_base (504)..(504): a, c, t, g, unknown or other
  misc_feature (504)..(504): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagccgtgggaggtccctgagactctcctgtgcaggctctggattcaccttcagtaactacggcgtgcacgtgggtccgccagggcctccgaggccgaagggcttggagtggctggctagttgtttcatctgaagagtgttacaatctanacagactccgtgaaacggccgattcaccatctccagtagacaataccaagacacgatagtatcgtananaangacagactaagagtagagacgacgtcttagttatacgtaggtaacgaagggagggatagaagngacgacgactacctacgtactacg

SEQ ID NO: 351918 - DNA, 552 bp, Homo sapiens
  misc_feature: GZ8MTXP02H68A5.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttcagtaactacggcgtgcactgtgtcccgccaggctccgaggcaaggggcttgggagtggctggcagttgttccatctgaaggatgttacatactatacagactccgtgaacgggccgattcaccatcctccagacgaacaacttacccaagaacacgatagtatactagacaaagtagaacagtaccgtaaagagttagaaggaaccgacggtcttagtttataacgtaggtaacggaaaggagggggataacgaggtaggacgagactacgtaaacgttacg

SEQ ID NO: 351919 - DNA, 554 bp, Homo sapiens
  misc_feature: GZ8MTXP02FUSYW.8.38.D05.1.454.CMB.2.raw
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (441)..(441): a, c, t, g, unknown or other
  misc_feature (441)..(441): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttcgtcgtagctctttaagaggtgtcagtgtcaagtgcaactggtggagtcgtggggggggctggtccagcctgggaggtccctgagctctcctgtgcaggctctggattcacttcagtaactacggcgtgcactggggtcccgccagggcctccgaggcaaggggcttggagtggctggctagttgttcatctagaagtagtgttacaatctatacagtacctccgtgaaacggggcctaattccaccatctccagagaccaattccaagaacngaatntatcnganaanagacgacgacgtagtagtagagacgtacgtacgttagttattacgtacgtaacggaacgggtaaggggtaagtagtaaggtacggacgacgtacgtacgtaacgtacgttacg

SEQ ID NO: 351920 - DNA, 616 bp, Homo sapiens
  misc_feature: GZ8MTXP02G848D.8.38.D05.1.454.CMB.2.raw
  modified_base (302)..(302): a, c, t, g, unknown or other
  misc_feature (302)..(302): n is a, c, g, or t
tcagctcgcgtgtccacgaccggtgctcgatttagtatctgatagttgagctctgggagaggagcccagcactagaagtcggcgtgtttccattcggtgatcagcactgaacacagaggactcaccatggagtttgggctgagcttgggttttcctcgttgctcttttaagaggtgtccagtgtcaagtgcaactggtggagtcggtggggggggctggtccagccgtgggaggtccctgagactctcctgtgcaggctctggattccaccttcaagtaactcggcgtgcacgtcgggtccnccaggcctccgaggcaaggggtcttggaggtggtcgtggctaggttcgtttcatcgtaggaaggtaagttgttacaaattcgtaatacgacgtacgtccggtaggaaacgggcccgtattccacctactcctaccaagacgactaaacttaaccgaaacgaaacacgtaatgtaactctagactaaagtacgaacgacgacgtaaagacgttaggaacgacgtacggtctttagtttaacttacgtaggtaacggaaacgggtacggggaattacgaaggtacggacgacgtactaccgtaacgttactttacg

SEQ ID NO: 351921 - DNA, 552 bp, Homo sapiens
  misc_feature: GZ8MTXP02JOP63.8.38.D05.1.454.CMB.2.raw
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggaggtcggtggggggggcgtggtccaggccgtgggacggtccctgagactctcctgtgcaggctctggattcaccttcagtaacgtacggcgtgcacgtcgggtccgccaggctccgaggcaagggtctggagtggctggctagttgttcatcgtagaaggtagtgtacaatctatacagactcgtagaacgggccatcaccatctacaganacaatacaanacacgatacgtanactagacaagtgaacagactaagtagtaggagacgacggtacttagttaatacgtaggtaaacggaaggacgggggtaatagaagtcggacacggtactacgtaacgtactttacg

SEQ ID NO: 351922 - DNA, 541 bp, Homo sapiens
  misc_feature: GZ8MTXP02HAHAK.8.38.D05.1.454.CMB.2.raw
  modified_base (299)..(299): a, c, t, g, unknown or other
  misc_feature (299)..(299): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaagtgcaactggtggagtcgtggggggggctggtccagcctgggagtccctgagactctcctgtgcaggctctggacttcaccttcagtaactacggcgtgcacgtgggcccnccaggcctccgaggcagggcttggacgtggctggctagttgttcatctagaaggtatgttacaatctatacagacttcgagaaggccgtatcaccatctacaganacactacaagacacgatgtaanctagacaatgaactagactaagagttagagacgacgtcgttagtttatacgtaggtaaacggagggaacggggtataacgaaggtggactacgtactaccgtaagttactttacg

SEQ ID NO: 351923 - DNA, 520 bp, Homo sapiens
  misc_feature: GZ8MTXP02IZHO8.8.38.D05.1.454.CMB.2.raw
  modified_base (295)..(295): a, c, t, g, unknown or other
  misc_feature (295)..(295): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtactacggctgcactgggtccnccagggctccgaggcaagggcttggagtggctggctagttgttcatctgaaggagtgttacaatctatacagacctcgtagaacgggcatcacntcncagagacatacaagacacgatgtatctagacaatagacagactaagagttagagacgacggtctgtttattacgtaggtaacgaagggagggggaatacgaagtggactacgctacaacgtacttacg

SEQ ID NO: 351924 - DNA, 530 bp, Homo sapiens
  misc_feature: GZ8MTXP02JTVZ5.8.38.D05.1.454.CMB.2.raw
  modified_base (203)..(203): a, c, t, g, unknown or other
  misc_feature (203)..(203): n is a, c, g, or t
  modified_base (365)..(365): a, c, t, g, unknown or other
  misc_feature (365)..(365): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatctttgatgcatccatcagggccactggcatcccagccaggttcagtggcaggtgggtctggggacagcttcnctctcaccatcagcagcctagagcctagaagtatttgactagtttattactgttacaacatcgtaccgagtcggccgtccgggggcctacgtttcggcccgtcgggaaccaaagtgagtactacaaacgaactgtcgctcgcacaatctgtctcactcctccgtc

SEQ ID NO: 351925 - DNA, 579 bp, Homo sapiens
  misc_feature: GZ8MTXP02GFWUU.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggaggtcggtggggggggctggtccaggccgtggggacggtccctgacgactctcctgtgcaggctctggattcaccttcagtaactacggcgtgcacgtcgggtccgccagggcctccgaggccgaaggggtcgttgggagtggcgtgggctagtttgtttcagtcgtagaaggtagtgttacaatacgtatacagtaccgtccgtaggaacgggccgtattccacctatcctaccaagacgaactaacttaccaaagaacacgtatgtactctagacaaagtgacagactaagagtagagacacggtcttagttatacgtagaacggtaaggaggggtatacgaaggtcgacgacgtacgtacgtaacgtactttacg

SEQ ID NO: 351926 - DNA, 552 bp, Homo sapiens
  misc_feature: GZ8MTXP02HCG3A.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagccgtgggaggtccctgagactctcctgtgcaggctctggattcaccttcagtaactacggcgtgcacgtcgggtccgccaggcctccgaggcaaggggtcttgggagtggctgggctagtttgtttcagtcgtagaaggagtgttacaatctatacagtactccgtagaacgggtccattcacatctccagagacaattaccaagaacacgaatagtatctagacaaagtagacagactaagagttagagacacggtactagtttattacgtagtaacgaaaggagggggaatacgaaggtagacgagtacgtacgtaacgttacttacg

SEQ ID NO: 351927 - DNA, 523 bp, Homo sapiens
  misc_feature: GZ8MTXP02HOGGE.8.38.D05.1.454.CMB.2.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
tcagctcgcgtgtccacgaccggtgctcgatttagtatctgatagttgggtttggggaggaactgctcagttaggacccagagggaaccatggaagccccagctcagcttctcttcctcctgctactctggctcccagataccaccggagagattgtgttgacacagtctccagccaccctgtctttgctccaggggaaanagccaccctctcctgcagggccagtcagagtgttaccacccagttagcctggtaccaacacaaacctggccaggctcccaggcccctcatctttgatgcatccatcaggccatggcatcccagccaggtcagtgcagtgggctgggacagacttcnctctcaccatcagcagcctagacgcctagaagtatttgctagtttattactgtacaacatcgtacgagtcggaccgtccgggggcctacgtttcggccgtgggaacctaaagttgaagtactacaaacgacgtagtgactgcacaagtctgtctcactcttccgcc

SEQ ID NO: 351928 - DNA, 584 bp, Homo sapiens
  misc_feature: GZ8MTXP02F1HRV.8.38.D05.1.454.CMB.2.raw
  modified_base (304)..(304): a, c, t, g, unknown or other
  misc_feature (304)..(304): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggtttcctcgttgctctttaagaggtgtccagtgtcaagtgcaactgggtggagtcggtggggggggctggtccagccgtggggaggtccctgagactctcctgtgcaggctctggattccaccttcagtaactacggcgtgcacgtcgggtcccnccgagggcctcccgagggccgaaggggtcttgggagtggcgtggctaggtttgtttcagttcgtagaaaggtagttgttacaaattactatacagtacctccggtagaaacgggccgtattcaccatctaccagacacaaattaccaaagaaacacgtatagtactactagacaaagagaacgagactaagtagtagaagtacgacggtacttagtttatacgtaggtaaacggaaaggtacgggggatacgaaggtgacgacgctactagtactttacg

SEQ ID NO: 351929 - DNA, 572 bp, Homo sapiens
  misc_feature: GZ8MTXP02I6NV3.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtggtcccgccaggctccgaggcaagggcttggagtggctggctagttgtttcatcgtagaaggagttgtacaatactataacagtactccgtagaacgggtccgattcacctatctaccagacgacaactaccaaagaacacgatagtatctagactaaagtagacacgactaagagtgacggacgacggtcttagtttaattacgtaggtaaacggaaagggtaacgggggtaataacgaaggtacggacgacgtacgtaccctaaggttaacctttaacg

SEQ ID NO: 351930 - DNA, 540 bp, Homo sapiens
  misc_feature: GZ8MTXP02JWYIQ.8.38.D05.1.454.CMB.2.raw
  modified_base (444)..(444): a, c, t, g, unknown or other
  misc_feature (444)..(444): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgccactgggtccgccaggcctccgaggccaaggggcttgggagtggctgggctaggtttcgtttcattcgtagaaaggtaagtgttacaaatcctaatacagactccgtagaaagggccgattcacatctccagagacaataccaagaacacgatgtanctagacaaatggacagacctaagagtagaggacacggtctagtttatactagaacgtaaaggagggggatagaagtgacgagcacaagtacttacg

SEQ ID NO: 351931 - DNA, 561 bp, Homo sapiens
  misc_feature: GZ8MTXP02GT1ZP.8.38.D05.1.454.CMB.2.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaactgccaggctcccaggcccctnatcttgatgcatccatcaggccactggcatccccagccaggttcagtggcaggtgggtctggggacagtacttcnctcncaccatcagcagcctagacgcctagaagtattttgactagtttattactgtacaaatactacgtaccgagtcggcccgtccgggggccctacgtttccggacccgtaggggaaccctaaaagttcgaacgtacgtacgaaacgtaacgtgtacggactcgaccactaatctcgtcttctactccgttacccgcc

SEQ ID NO: 351932 - DNA, 614 bp, Homo sapiens
  misc_feature: GZ8MTXP02IEIEF.8.38.D05.1.454.CMB.2.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (317)..(317): a, c, t, g, unknown or other
  misc_feature (317)..(317): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttcgtcgtaggctctttaagaggtgtccagtgtcaagtgcaactggtggagtcgtggggggggctggtccagcctgggaggtccctgagctctcctgtgcaggctntggattcaccttnagtacncgcgtgcncgtcggccncgacgctacgagacgaggtcgtggngtcggtcgtgcgtgttgtcacgtgtagtagtagtagtactaactactactactacgtacgtacgtacggacggacgtactacacctactacctacgacgacgaactaactaaccgaaacgaacgaacgtagtagtactacgtacgaacgtaacgtacgaacgaacgtaacgtaagtaggtaggtacggacgtacggtacgttagtttagttaacgttaacggtaaacgggtaaacggggtaacggggtaagtaacggtaacggtacggacgacgtacgtacgtaacgttacgttacg

SEQ ID NO: 351933 - DNA, 719 bp, Homo sapiens
  misc_feature: GZ8MTXP02HFKL7.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaagtgcaactggtggaggtcggtggggggggctggtccagccgtgggacggtccctgagctctcctgtgcaggctctggacttcaccttcagtaactacggcgtgcacgtcgggtcccgccaggcctccgaggcgaaggggtcttggagtggcgttgggctaggtttgtttcagttcgtaggaaaggtaagttcgttacaaattacctaagtaacacggtacccttccgtaggaaacggggtcccgtattacccaaccactacctacccaagaacgaacctaaacttacccgaaaagaaaccaacgtaagtagttaactacgtagaactaaaagtacggaacaacggtaaccgtaaaggtacggttaaggaacggtaaccggaaccggttacgtttaacggttttaaacgttaaaccggttaaggggttaaaaccgggtaaaaacgggggacggggggttaaaactaacgggtaacgggtaggaaccgtacgtaacccgttaacccgttaaaacggttaacccgttttaaccg

SEQ ID NO: 351934 - DNA, 616 bp, Homo sapiens
  misc_feature: GZ8MTXP02G8KBL.8.38.D05.1.454.CMB.2.raw
  modified_base (201)..(201): a, c, t, g, unknown or other
  misc_feature (201)..(201): n is a, c, g, or t
  modified_base (363)..(363): a, c, t, g, unknown or other
  misc_feature (363)..(363): n is a, c, g, or t
tcagctcgcgtgtccacgaccggtgctcgatttagtatctgatagttgggtttggggaggaactgctcagttaggacccagagggaaccatggaagccccagctcagcttctcttcctcctgctactctggctcccagataccaccggagagattgtgttgacacagtctccagccacctgtctttgtctccaggggaaangccacctctcctgcagggccagtcagagtgttaccaccagttacgcctggtaccaacacaaacctggccaggctcccaggcccctcatctttgatgcatccatcagggccactggcatccccagccaggttcagtggcaggtgggtctggggacagacttcnctctcaccatcagcagcctagacgcctagaagtattttgactagttttattacttgtacaaactattacggtaccgtagtcgggtcccggttacccgggggccctaccggtttccggccccgtacgggaaccctaaaagtttcggaacggtaaacttaccgaaaacggtaaccgttaggtacggggtaccttcggacctaaccgtaacgttccttcggttaccttaccgtacctttcccgtttccccgtaccc

SEQ ID NO: 351935 - DNA, 507 bp, Homo sapiens
  misc_feature: GZ8MTXP02JISYT.8.38.D05.1.454.CMB.2.raw
  modified_base (393)..(393): a, c, t, g, unknown or other
  misc_feature (393)..(393): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttcagtaactacggcgtgcacgtgggtccgccaggctccgaggcaagggcttggagtggctggcagttgttcatctgaagagtgttacaatctatacagactcgtgaaggcgatcacatctcaganacaatacaagaacacgatagtatctagacaatagacagactaagagttagagacacgctagttatactagtacgaagagggggatacgaagtggacacgctacaacgtactacg

SEQ ID NO: 351936 - DNA, 571 bp, Homo sapiens
  misc_feature: GZ8MTXP02I5SUF.8.38.D05.1.454.CMB.2.raw
  modified_base (420)..(420): a, c, t, g, unknown or other
  misc_feature (420)..(420): n is a, c, g, or t
  modified_base (477)..(477): a, c, t, g, unknown or other
  misc_feature (477)..(477): n is a, c, g, or t
  modified_base (517)..(517): a, c, t, g, unknown or other
  misc_feature (517)..(517): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagccgtgggaggtccctgagactctcctgtgcagcctctgggttcaccttcagtagctacggcatgcacgtgggtcccgaccaaactccgaggacaagggattggaggtgggtggctaggtttgttcatcccgtggagggcaggttgttacaatgggtatgctgaccgcgtaggacgggctattccacgatctcaganacactcagacacaatgtatttgacctgaacacgctaagtccgtagagacgacgggtntaactactacgtggtaaacggaaggggacggggaaaccgngggacgggtaacgttaccgaaaggttacctaccggttgaaccgtcgtccggggg

SEQ ID NO: 351937 - DNA, 512 bp, Homo sapiens
  misc_feature: GZ8MTXP02GG6N1.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccgccaggctccaggcaagggcttggagtggctggcagttgtttcatctgaaggaatgttcaatcatacagactcgtgaaagggccgattcaccatctccagagacaattccaagaaacacgatgtatctgacaaatggacagacctaagagttgaggacacggctgttatactagtacgaaagagggggatacgaagtggacagctacaagtactac

SEQ ID NO: 351938 - DNA, 578 bp, Homo sapiens
  misc_feature: GZ8MTXP02I3X11.8.38.D05.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccaccagttacgcctggtaccaacacaaacctggccaggctcccaggcccctnatcttgatgcatccatcaggccactggcactcccagccaggttcaggtggcaggtcgggtctaggggacagtacttcactctacaccatcagcagcctagacgctagaagtatttgcttagtttatactgtacaaactactacgtacgtagtcgggtcccggtaccgggggccctaccggtttccggcccgtacgggaacctaaaagttcgaagtacgtacgaaaacgtacgtaggtacggcgtacgcctaacaacgttctcgttaccttacacttcccgttcccgac

SEQ ID NO: 351939 - DNA, 565 bp, Homo sapiens
  misc_feature: GZ8MTXP02GUZT3.8.38.D05.1.454.CMB.2.raw
  modified_base (298)..(298): a, c, t, g, unknown or other
  misc_feature (298)..(298): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtcccnccaggcctccaggcaaggggcttggagtggcgtggctagttgtttcatctgaaaggtagtgttacaatactatacagactccgtagaacggccgatcacatctccagagacaatacaagaacacgatagtatctagacaaagtagacacgacctaagtagttaggaacggacacggtacttagtttatttaacgtaggtaaacggaaacggggtaacgggggaagtacgaaggtcggacgacggactaccgtaacgttactttaacg

SEQ ID NO: 351940 - DNA, 552 bp, Homo sapiens
  misc_feature: GZ8MTXP02JYHWB.8.38.D05.1.454.CMB.2.raw
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccnccaggcctccgaggcaagggcttggagtggctggctagttgtttcatcgtagaaggtaatgttacaattctanacagactccgtagaaagggccattcacatctacagagacaattaccaaagaacacgaatgtatctagacaaagtggacagacctaagagttagagacgacggtcttagtttatacgtaggtaacgaaagggacgggggtaatagaagtacggacgacggtactacgtaacgtactttaacg

SEQ ID NO: 351941 - DNA, 545 bp, Homo sapiens
  misc_feature: GZ8MTXP02F23FI.8.38.D05.1.454.CMB.2.raw
  modified_base (302)..(302): a, c, t, g, unknown or other
  misc_feature (302)..(302): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctcgtggattcaccttcagtaactacggcgtgccacgtgggtcccnccaggcctccgaggcgaagggcttgggagtggctggctagttgtttcattcgtagaaggtagttgttacaatctatacagactccgtgaaacgggcgatcaccatctacagagacaatacaagaacacgatgtatctagacaaagtggaacagactaagagttgaggacacggtacttgtttactactaggtaacgaaagggagggggatagaagtagacgacgctaccgaagttacttaacg

SEQ ID NO: 351942 - DNA, 527 bp, Homo sapiens
  misc_feature: GZ8MTXP02HGI3V.8.38.D05.1.454.CMB.2.raw
  modified_base (298)..(298): a, c, t, g, unknown or other
  misc_feature (298)..(298): n is a, c, g, or t
  modified_base (345)..(345): a, c, t, g, unknown or other
  misc_feature (345)..(345): n is a, c, g, or t
  modified_base (450)..(450): a, c, t, g, unknown or other
  misc_feature (450)..(450): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggttttcctcgtgctctttaagaggtgtccagtgtcaagtgcaactggtggagtcgtggggggggctggccagccgtgggacggtccctgagactctcctgtgcaggctctggattcaccttcagtaactacggcgtgcacgtcgggtccncccagggctccgaggccaagggcttggagtggctggctagttgttcntctgaaggagttgtacaatctatacagctccgtgaaacggccgattcacatctcagacacattaccaagacacgatagtatctagacaatggacagaccgtaagngttagaggtacacgtacgtgtttatactagtaacggaagacgggggatagaagtgagacgctacctagtactttacg

SEQ ID NO: 351943 - DNA, 593 bp, Homo sapiens
  misc_feature: GZ8MTXP02IK3P5.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagctctcctgtgcaggctctggattcaccttcagtaactacggcgtgcacgtcggggtcccgccagggcctccgaggccgaaggggcttgggagtggctgggctaggtttgtttcagttcgtaggaaaggtaagttgtttaccaaattacttaataacgaggtacccttccgggtaggaaacggggtcccgtaattccaaccctatcctaccagtaacgactaattaccaaagaacacgatgtatctagacaatagacagacctaagagttgagacgacggtacttagtttatacgtaggtaaacggtaaggaacgggggtatacgaagtcggacacgactactaacgtacttacg

SEQ ID NO: 351944 - DNA, 540 bp, Homo sapiens
  misc_feature: GZ8MTXP02FNWNZ.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccaggcctccgaggcaagggcttggagtggctggcagttgtttcatctagaaggtagtgttacaatactatacagacctccgtagaaacgggcccgattcaccatctccagacgactaattaccaaagaacacgatgtatactagacaaagtggaacagacctaagagttagaagacgacggtcttagtttatactagtaacgaaggagggggatagaagtgacagctacgaagtacttacg

SEQ ID NO: 351945 - DNA, 580 bp, Homo sapiens
  misc_feature: GZ8MTXP02HOLL0.8.38.D05.1.454.CMB.2.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
tcagctcgcgtgtccacgaccggtgctcgatttagtatctgatagttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccaccagttagcctggtaccaacacaaacctggccaggctcccaggcccctnatctttgatgcatccatcaggccactggcatcccagccaggttcagtggcagtgggtctgggacagacttnacttcncaccatcagcagcctagacgcctagaacgtattttagcttaagtttattactagtactaaactattccgtacgtagtcggtccgtcccgggggtacctaccgtttccgggcccgttacggggaaccctaaaagttcgaacgtacgtacgaaaacggtaaacgttggtacggtactcgaccactaacgtctcgttctctacttccttacccgtacc

SEQ ID NO: 351946 - DNA, 534 bp, Homo sapiens
  misc_feature: GZ8MTXP02HZK8M.8.38.D05.1.454.CMB.2.raw
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagactctcctgtgcaggctctggattcaccttcagtaactacggcgtgcacgtgggtccnccagggctccgaggcagggcttggagtggctggcagttnttcatctgaaggagttgtacaatctatacagactccgtgaagggcccgattcaccatctaccagagacaatacaagacacgatgtatctgacaatgacagactaagagttgagacacggtcttagtttaatactaggtaaacgaaagggacgggggaatacgaaggtacggacacggctaccgtaagttactttaacg

SEQ ID NO: 351947 - DNA, 515 bp, Homo sapiens
  misc_feature: GZ8MTXP02FF9Q8.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggcgtggtccagcctgggaggtccctgagactctcctgtgcaggctctggattcaccttcagtaactacggcgtgcactgtgtccgccaggctccaggcaaggggcttgggatgggctgggcaggttgttcccatctgaaggagtgttcatactatacagactcgtgaagggccgattcaccatctccagagacaattccaaagaacacgatgtatctgacaaatggacagacctaagagtgaggacacggctgtttatactagtaacgaaaggagggggataacgagtggcagcacgagtacg

SEQ ID NO: 351948 - DNA, 533 bp, Homo sapiens
  misc_feature: GZ8MTXP02GOXWJ.8.38.D05.1.454.CMB.2.raw
  modified_base (297)..(297): a, c, t, g, unknown or other
  misc_feature (297)..(297): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccnccaggctccaggcaagggcttggagtggctggcagttgtttcatctgaaggagtgttacaatctatacagtactccgtagaacgggccgattcacatctccagagacaatccaagaacacgaatgtatctagacaaatggaacacgacctaagagttagaggacaacggcttgtttattacgtagtaacggaaaggagggggtatacgaagtggacacgactaccaagtacttacg

SEQ ID NO: 351949 - DNA, 543 bp, Homo sapiens
  misc_feature: GZ8MTXP02H6UQ9.8.38.D05.1.454.CMB.2.raw
  modified_base (510)..(510): a, c, t, g, unknown or other
  misc_feature (510)..(510): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagccgtgggaggtccctgagactctcctgtgcaggctcgtggattcaccttcagtaactacggcgtgcacgtcgggtccgccagggcctccgaggcgaaggggcttgggagtggcgtggctaggtttgttcagtcgtagaaggagtgttacaatactataacagactccgtagaacggcactcacatctccagacgacaactacaagacacgatagtatactagacaatggacagactaagagtagagacacggtctagtttatactaggtaacgtaaaggagggganacgaagtcggacgacgctaccgaagtacttacg

SEQ ID NO: 351950 - DNA, 589 bp, Homo sapiens
  misc_feature: GZ8MTXP02IV84A.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagctctcctgtgcaggctctggatcaccttcagtaactacggcgtgcacgtcgggtccgccaggcctccgaggcgaagggtcttgggagtggctggctagtttgtttcatcgtagaaggaagttgttacaatctatacagactccgtagacgggcgtatcacctatctacagacgactaattaccaaagaacacgatgtatcgtagacaaagtgacacgacgtaagagttacggaaggacgtaccggtactttggtttaaacttacgttacggttaaacggaaaacggggaaggggggtaacttaacggaaggtggacgaacggtactaaccgtaaacggttactttaacgg

SEQ ID NO: 351951 - DNA, 661 bp, Homo sapiens
  misc_feature: GZ8MTXP02H25J8.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggtagtttgggctgagcgttgggttttcctcgttgcttcttttaagaggtgtccagtgtcaagtgcaagtggtggagtcggtgggggggctggtccagccgtgggacgtcctgagctctctgtgcaggctcgtggtacttcaccttgaagtaaccgtacggcgtgccacgtcgggtcccgccaggcctccgagggacgaagggtcgttaggaggtcgggcgtgggccttaggtttcgtttacagttccgtaaggtaaagggtagttcgtttacaaattactaagttaacacgtaccgtacccggtaggaaacgggtcccgtacttacaaccactacctaccaagtacgaaactaacgttaaccaaaacgaactaacgattagtaaactcgtagaacgtaaaagtcgggaacaacgtaaccttaaaggtagttaagggaagaccgaacgggttctaaggttttataacgtaggtaaacggaaagggacgggggtaatagtaaggaggacacggactaccgaatttacgttacg

SEQ ID NO: 351952 - DNA, 561 bp, Homo sapiens
  misc_feature: GZ8MTXP02JLBGZ.8.38.D05.1.454.CMB.2.raw
  modified_base (302)..(302): a, c, t, g, unknown or other
  misc_feature (302)..(302): n is a, c, g, or t
  modified_base (401)..(401): a, c, t, g, unknown or other
  misc_feature (401)..(401): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtggggggggctggtccagccgtgggaggtccctgagactctcctgtgcaggctctggattcaccttcagtaactacggcgtgcacgtcgggtcccnccagggcctccgaggcgaaggggcttggagtggctgggctagttgttcatcgtagaaggtagtgtacaatctatacagactcgagaacggccgatcacntctccagagacaactacaagaacacgaatgtatctagacaagtagaacacgacctaaggtagttaggaacggacgaacggtacgttagtttattacgtaggtaacggaaacgggacgggggtaatacgaaggtcggacgagactaccgaagtacttaacg

SEQ ID NO: 351953 - DNA, 576 bp, Homo sapiens
  misc_feature: GZ8MTXP02GCXH8.8.38.D05.1.454.CMB.2.raw
  modified_base (298)..(298): a, c, t, g, unknown or other
  misc_feature (298)..(298): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcagtactacggcgtgcacgtgggtccnccaggcctccgaggcaagggcttggagtggctggctagttgttcatctagaaggtattgttacaaatctatacagtactccgtagaaacgggcctagttcaccactctaccagacgacaacttaccaaagaacacgatagtatctagacaaagtgaacacgacctaaagagttagaggacgacggtacttagtttacttaacgtagtaacggtaaaagggaacgggggaattaacgaaggtacggacgtacgtacgtacccgtaagttacctttaacg

SEQ ID NO: 351954 - DNA, 619 bp, Homo sapiens
  misc_feature: GZ8MTXP02HC75P.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctcgtggattcaccttcagtaactacggcgtgcacgtcgggtcccgccagggcctccgaggcaaggggtcttgggagtggctgggctagttgtttcattcgtaggaaggtagttgttacaagttactatacagtaccttccggtagaaacggggccgtaacgttccaaccctatcctacccgaagaacgtaccaaacttacccaaagaaaccgaacgattacgtatcgtagaacaaagtaggaacacgtacgtaaagtcgttagacggtacgacggtacttagtttaagtacgtaggtaaacggaaaggggagggggtaataacggaaggtcggacgacgtacgtacctaacgttactttaacg

SEQ ID NO: 351955 - DNA, 538 bp, Homo sapiens
  misc_feature: GZ8MTXP02H446V.8.38.D05.1.454.CMB.2.raw
  modified_base (396)..(396): a, c, t, g, unknown or other
  misc_feature (396)..(396): n is a, c, g, or t
tcagctcgcgtgtccacgaccggtgctcgatttagtatctgatagttgagctctgggagaggagccccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcacctttcagtaacctacggcgtgcactgggtccgccaggctccaggcaagggcttggagtggctggctagttgtttcatctagaaaggagttgttacaaatctatacagactcgtgaagggcgatcacanctcagagacaattacaagacacgatgtatactgacaatagacagactaagagttagaggacacggtctagtttattactaggtaacgtaaaggaagggggataagaaggtacggacgaggactacctaaacgtactttaacg

SEQ ID NO: 351956 - DNA, 540 bp, Homo sapiens
  misc_feature: GZ8MTXP02JQY4U.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctcgtggattccaccttcaagtaactacggcgtgcacgtcgggtccgccagggcctccgaggcgaagggcgttggagtggctgggctagtttgttcatcgtagaagagttgttacaatctatacagctcgtgaacggcgtatcacatctcagagacaataccaaagacacgatgtatctagacaagtagacagacctaagagttagagacgacggtctagtttattacgtagtaacgaaagggagggggtatagaaggcgacgacgactacgtaacgtactacg

SEQ ID NO: 351957 - DNA, 557 bp, Homo sapiens
  misc_feature: GZ8MTXP02GDMU3.8.38.D05.1.454.CMB.2.raw
  modified_base (297)..(297): a, c, t, g, unknown or other
  misc_feature (297)..(297): n is a, c, g, or t
  modified_base (440)..(440): a, c, t, g, unknown or other
  misc_feature (440)..(440): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggctggtccagcctgggaggtccctgagactctcctgtgcaggctctggattcaccttcagtaactacggcgtgcacgtgggtcccncaggcctccgaggcaagggcttggagtggctggctagttgtttcatctgaaggatgttacaatctatacagacctccgtagaaacgggcccgtattccaccgtctccgagtagacaacttacaaagaacacgatagtatctanacaaatgacagacctaagagtagaggacgacggtacttagtttaagttacgtaggtaaacggaaaggtacgggggaataacgaggtggacacgcgtaccaaggtacttactttacgg

SEQ ID NO: 351958 - DNA, 528 bp, Homo sapiens
  misc_feature: GZ8MTXP02IJNYR.8.38.D05.1.454.CMB.2.raw
  modified_base (298)..(298): a, c, t, g, unknown or other
  misc_feature (298)..(298): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagactctcctgtgcaggctctggattcaccttcagtaactacggcgtgcacgtgggtcccnccaggcctccaggcaagggcttggagtggctggctagttgttcatcgtagaggtagtgttacaatctatacagacctccgtgaacggccgatcacatctccagagacaattacaagaacacgaatgtatctagacaaatagacagactaagagtagagacacggtctagtttattactagtaacgaaaggaggggtatacgaagtgacgagactacaacgttacttaacg

SEQ ID NO: 351959 - DNA, 537 bp, Homo sapiens
  misc_feature: GZ8MTXP02GCQGH.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccaggcctccgaggcaaggggtcttggagtggctggcagttgtttcatcgtagaaggtatgttacaatctatacagactccgtagaacgggccgattcaccatctaccagagacaataccaagaacacgatgtatctagacaaatgaacagacctaagagtgagacgacgcttagttattacgtagtaacggaaaggacgggggatacgaagtggacacgactacgaacgtactttacg

SEQ ID NO: 351960 - DNA, 641 bp, Homo sapiens
  misc_feature: GZ8MTXP02GHQ5S.8.38.D05.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (363)..(363): a, c, t, g, unknown or other
  misc_feature (363)..(363): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttagcctggtaccaacacaaacctggccaggcctcccaggcccctnatcttgatgcatccatcaggccactggcactcccagccaggttcagtggcaggtggtctgggacagtcttcnctctcacatccagcagcctagacgcctagtaagtattttgacttagtttacttactagtactaaacgtacttcggtaaccgtaggttcgggcccggttacccgggggacccttaccggtttcccgggtaccccgttaacgggggtaaaccctaaaaaggtttcggaaacgtaaacgttaaccgaaaacggtaaacgttgggtacgggtacttaccggaccctaaccgtaacgttccttacggttaccttaccgtaactttcccgtttccccgtaaccc

SEQ ID NO: 351961 - DNA, 596 bp, Homo sapiens
  misc_feature: GZ8MTXP02H3UXJ.8.38.D05.1.454.CMB.2.raw
  modified_base (190)..(190): a, c, t, g, unknown or other
  misc_feature (190)..(190): n is a, c, g, or t
  modified_base (300)..(300): a, c, t, g, unknown or other
  misc_feature (300)..(300): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtncaactggtggagtcgtggggggggctggtccagccgtgggaggtccctgagactctcctgtgcaggctctggattcaccttcagtaactacggcgtgcacgtcgggtccnccaggcctccgaggcaagggcttggagtggctggctagttgttcatcgtagaaggagttgttacaatctatacagtactccgtggaacggccgatcacatctcagagacaattaccaagacacgatagtatacttagacaaagtcggaacaacgaccttaaaggagttaggaacgggtaacgaacgggtcttaaggttttacgttaaccgtaaggttaaaccggaaaaggggtagggggtaactaacggtaagggtacggacgacgtacgtacccgtaaacggttacctttaacgg

SEQ ID NO: 351962 - DNA, 517 bp, Homo sapiens
  misc_feature: GZ8MTXP02F017X.8.38.D05.1.454.CMB.2.raw
  modified_base (414)..(414): a, c, t, g, unknown or other
  misc_feature (414)..(414): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccgccaggctccgaggcaagggcttggagtggctggcagttgttcatctgaaggagtgttacaatctatacagtacctccgtagaacgggccgattcacatctccagacgacaatacaanaacacgatgtatctgacaatagacagactaagagttagagacacggctgtttatactagtaacgaaggaggggatacgaagtgacacgactacagtacttacg

SEQ ID NO: 351963 - DNA, 582 bp, Homo sapiens
  misc_feature: GZ8MTXP02I1XSP.8.38.D05.1.454.CMB.2.raw
  modified_base (263)..(263): a, c, t, g, unknown or other
  misc_feature (263)..(263): n is a, c, g, or t
  modified_base (449)..(449): a, c, t, g, unknown or other
  misc_feature (449)..(449): n is a, c, g, or t
  modified_base (458)..(458): a, c, t, g, unknown or other
  misc_feature (458)..(458): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctggggaggtccctgagactctcctgtgcaggctctggnttcaccttcagtactacggcgtgcacgtgggtccgccagggctccgaggcgaaggggcttgggagtggctggctagttgttcagtctagaaggagttgttacaatctatacagtacctccgtgaaacggggcccattccaccatcctaccagacgactaatccgaagacactaatgttattgggangtagaaacncgtacgtagtcgtaggacgacgacggtactactacgtagtacggtaaacggacggggacggggaacgacggggacggtaacgttacgaacgttaccgtacggttacggaccgtcggtaccgggg

SEQ ID NO: 351964 - DNA, 568 bp, Homo sapiens
  misc_feature: GZ8MTXP02JYW4G.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtcccgccaggctccgaggcaaggggcttgggagtggctggctagttgtttcatctaggaaggtagtgttacaatctatacagactccgtaggaacgggccgattcaccatctaccagacgacaacttaccaagaacacgatagtatctagacaaagtgaacacgaccgtaagagttaggaggacgacggtcttagtttatacgtaggtaacggaaacgggagggggtaatacgaaggtacggacgtacgacgtaccgtaacggttactttaacg

SEQ ID NO: 351965 - DNA, 579 bp, Homo sapiens
  misc_feature: GZ8MTXP02HH5JE.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcgtggggggggctggtccagccgtgggagtccctgagactctcctgtgcaggctcgtggtacttccaccttcagtaactacggcgtgccacgtgggtcccgccagggcctccgaggcgaagggcttgggagtggctggctagtttgtttcagttcgtaggaaggtagttgttacaatactatacagtacctccgtagaacggccgatcaccactctacagagaactaaactaccaaacgaacacgtatagtatctagacaaagtaggaacacgacctaagtagtagacgacgacgtctagtttatacgtaggtaaacggaaaggacgggggaatacggaagtacggtacgagaccgtacgaacgttacttaacg

SEQ ID NO: 351966 - DNA, 609 bp, Homo sapiens
  misc_feature: GZ8MTXP02HCUXP.8.38.D05.1.454.CMB.2.raw
  modified_base (297)..(297): a, c, t, g, unknown or other
  misc_feature (297)..(297): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggacgtccctgagactctcctgtgcaggctctggattcaccttcagtaactacggctgcacgtgggtccncaggcctaccgagggcaaggggtcttgggagtggcgtggctaggtttgtttcacgttcgtaggaaaggtacgttgttaccaaattaccgtaataacacggtaccttccggtaaggaacggggtccgtacttaccaacctactacgtcccaagacgtaactaaacttaccaaacggaacaacgtatagtaatctagaccaaagtacgacgacgactaaggagttagacggacgacggtacttagtttactacgtaggtaacggaaaggtacgggggatacgaaggtgacgacgacgtacgaacgtacttaacg

SEQ ID NO: 351967 - DNA, 512 bp, Homo sapiens
  misc_feature: GZ8MTXP02F3021.8.38.D05.1.454.CMB.2.raw
  modified_base (296)..(296): a, c, t, g, unknown or other
  misc_feature (296)..(296): n is a, c, g, or t
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttcagtaactacggcgtgcactgggtccncaggctccaggcaagggcttggagtggctggcagttgtttcatctgaagaagtgttacaatctatacagactccgtgaaagggcgatcacatctcagagacaattaccaaagaaacacgatgtaatctgcaaaatggaacagacctaagagttgaggacacggctgtttattactagtacgaaagagggggatanaagtgcagcncaagtactacg

SEQ ID NO: 351968 - DNA, 612 bp, Homo sapiens
  misc_feature: GZ8MTXP02JNMYN.8.38.D05.1.454.CMB.2.raw
  modified_base (307)..(307): a, c, t, g, unknown or other
  misc_feature (307)..(307): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtggggggggctggtccagccgtgggacggtccctgagactctcctgtgcaggtctcgtggtacttcaccttcagtaactacggcgtgcctacgtcggtccnccaggcctccgaggcgaagggcgttggagtggctggctagttgtttcagtcgtagaaggtagttgttacaattctatacagtacctccgtaggaacgggtccgtattccgaacctactcctaccgaagaacgtaactaaacttaacccaaagaaaccaacgtatagtatctaagactaaagtgaacacgaccgtaaggtacgttagacggtacgtacggtcgttagtttataacgtaggtaaacggaaagggtaggggtactagaaggtacggacgacgaccgtaccgtaaacggttctttaacg

SEQ ID NO: 351969 - DNA, 672 bp, Homo sapiens
  misc_feature: GZ8MTXP02G5450.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtggggggggctggtccagccgtgggacggtccctgagactctcctgtgcaggctctggattccaccttcagtaacctacggcgtgcacgtcggtccgccgaggcctccgaggcgaagggtcgttggagtggcgtggctagtttgtttcacgtcgtaggaaaggtagttgttacaatctatacagtacctccggtaggaacggtccgtacttccaacctatcctacgaagacgaacctaaacttacccgaaaagaacaacgtaatacgttaactacgtaagaactaaagtacgaacgacgtaaccgtaaaggtaacggttacggaacggtaccgtacggttacgtttaagtttaacttaaccggtaaagggttaaacgggaaaacgggggtaacgggggtaataacggtaagggttacggaacctaacggtaccgtaaccgtaaacggtttaaccttttaacgg

SEQ ID NO: 351970 - DNA, 553 bp, Homo sapiens
  misc_feature: GZ8MTXP02JAMII.8.38.D05.1.454.CMB.2.raw
  modified_base (302)..(302): a, c, t, g, unknown or other
  misc_feature (302)..(302): n is a, c, g, or t
  modified_base (442)..(442): a, c, t, g, unknown or other
  misc_feature (442)..(442): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtggggaggtccctgagactctcctgtgcaggctctggattcaccttcagtaactacggcgtgccacgtgggtcccnccaggcctccgaggcaaggggcttggagtggctggctagttgtttcatctgaaggaagttgtacaatctatacagactccgtagaacgggtccgattcacactctaccagacgacaattaccaaagaacacgatacgtanctgacaaataggacagactaagagttaggaggtacgacggtacttaggtttatacgtagtaacggaaaggtacgggggatacgaagtgacgagctacgtaacgtacttacg

SEQ ID NO: 351971 - DNA, 574 bp, Homo sapiens
  misc_feature: GZ8MTXP02G7AT2.8.38.D05.1.454.CMB.2.raw
  modified_base (303)..(303): a, c, t, g, unknown or other
  misc_feature (303)..(303): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcggtgggggggcgtggtccagccgtgggaggtccctgagactctcctgtgcaggctctggattcaccttcagtaacgtacggcgtgcacgtcgggtccnccgaggcctccgaggcgaagggtcttggagtggcgtggctagttgtttcagttcgtaggaacggtagttgttacaattactatacagtacctccggtaggaacgggccgtattccacctatcctaccagaagactaacttaccaaagaacacgatatactctagactaaagtacgaacacgacctaagtagttagaacggacacggtcttagtttatacgtagaaacggaaggaggggatacgaagtgacgacgcgtactacgtacttacg

SEQ ID NO: 351972 - DNA, 546 bp, Homo sapiens
  misc_feature: GZ8MTXP02I2TKM.8.38.D05.1.454.CMB.2.raw
  modified_base (300)..(300): a, c, t, g, unknown or other
  misc_feature (300)..(300): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctggggaggtccctgagactctcctgtgcaggctctggattcaccttcagtaactacggcgtgcacgtggggtccnccagggctccaggcaaggggcttggagtggctgggctagttgtttcatctagaaggagttgttacaatctatacagtacctccgtagaagggcccgattcaccatctccagagacaattaccaagaacacgatagtatctagacaatggaacagacctaagagttagaggacacggtctagtttatacgtaggtaacggaaggacgggggatacgaaggtggacacggctacgaacgtactttacg

SEQ ID NO: 351973 - DNA, 624 bp, Homo sapiens
  misc_feature: GZ8MTXP02JOR7A.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagccgtggggacggtccctgagactctcctgtgcaggctctggattcaccttcagtaactacggcgtgcacgtgggtcccgccagggcctccgaggcaaggggtcttggagtggctgggactaggttgtttcagttcgtaggaaaggtaagttcgttacaaattctaatacaagtaccgtccggtagaaacgggtcccgtacttaccaccctactctacccaagaacgaactaacttacccaaagaacacgatgtaatctagactaaagtagacacgtacctaaagtaggttaggaaggaacgacggtcttagtttaacttaacgtacggttaaacggaaacgggtaacgggggtaagtaacgaaggtggacgtacggctaacccgtaagttactttaaccg

SEQ ID NO: 351974 - DNA, 687 bp, Homo sapiens
  misc_feature: GZ8MTXP02GO8HM.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggaggtcggtgggggggggctggtccaggccgtgggagtccctgagactctcctgtgcaggctctggattcaccttcagtaactacggcgtgcacgtcgggtcccgccgaggcctccgaggacgaaggggtcttgggaggtggctgggctaggtttgtttcattcgtaggaaggtaagttgttacaattctaatacgagtacctccgtaggaaacgggtccgattcaaccctattccaccaaggacaacctaattacccgaaaagaaaccgacgtaattacgttaataccgtagaactaaaagtcggaacctaacggtacctaaagggtaacgttaggaacgggtaaccgtaccggggttactttaggttttaaacttaaaccggttagggtaaaaccgggtaaaagggggtaacggggggtaattaacggaaggggttcggaacggtaacggtaccgtaaccgttaaaggttaaccttttaaccgg

SEQ ID NO: 351975 - DNA, 596 bp, Homo sapiens
  misc_feature: GZ8MTXP02H25CI.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctctgtgcaggctctggattcaccttcagtaactacggcgtgcacgtcgggtccgccaggcctccgaggcgaagggcttgggagtggcgtggctaggtttcgttcatcgtaggaacggtagttgttacaaattactaataacagtaccgttccgtagggaaacggccgtattaccgacctactcctaccagacgaacaacttaccaaagtacaacgtatagtatctagaacaaagtacggacaacgaccgtaaaggagttagaggacgacggtcttagtttattacgtaggtaaacggaaagggagggggaatacgaaggtggacgacgacgtaccgaacgtttacttaacg

SEQ ID NO: 351976 - DNA, 532 bp, Homo sapiens
  misc_feature: GZ8MTXP02GZYU5.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagactctcctgtgcaggctctggattcaccttcagtaactacggcgtgcactgggtccgccagggctccgaggcaaggggcttggagtggctggctagttgtttcatcgtgaaggagtgttacaatactatacagactcgtgaacgggcgatcacatctcagagacaattaccaagaacacgatagtatctgacaaatggacagacctaagagttagaggacgacggtcttagtttattactaggtaacgaaagggagggggatacgaaggtgacgagctactaacgtacttacg

SEQ ID NO: 351977 - DNA, 574 bp, Homo sapiens
  misc_feature: GZ8MTXP02JI3RL.8.38.D05.1.454.CMB.2.raw
  modified_base (414)..(414): a, c, t, g, unknown or other
  misc_feature (414)..(414): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccaggctccgaggcaagggcttggagtggctggcagttgttcatcgtagaaggaagtgtacaatctatacagactccgtagaacgggccgatcacatctccagagacaataccaanaacacgatgtatctagacaaagtgaacagtaccgtaaagtagttagaaggacgacggtacttaggtttaacttaacgtaggtaaacggaaagggtaacgggggaattaacggaaggtacgggacgtaacggaccgtaccgtaaacggttactttaaccgg

SEQ ID NO: 351978 - DNA, 507 bp, Homo sapiens
  misc_feature: GZ8MTXP02FV657.8.38.D05.1.454.CMB.2.raw
  modified_base (295)..(295): a, c, t, g, unknown or other
  misc_feature (295)..(295): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggctggtccagcctgggaggtccctgagactctcctgtgcaggctctggattcaccttcagtaactacggcgtgcactgggtccnccaggctccaggcaagggcttggagtggctggcagttgttcatctgaagagtgttcaatctatacagactccgtgaagggccgattcaccatctccagagacaattaccaagacacgatgtatctgacaaatagacagacctaagagttgagacacggctagtttatacgtagtacgaaagagggggatagaagtgcagcaccagacttacg

SEQ ID NO: 351979 - DNA, 537 bp, Homo sapiens
  misc_feature: GZ8MTXP02JFDNI.8.38.D05.1.454.CMB.2.raw
  modified_base (509)..(509): a, c, t, g, unknown or other
  misc_feature (509)..(509): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccagggctccgaggcaagggcttgggagtggctggctaggttgtttcagtcgtagaaggtagtgttacaatctatacagactccgtagaacgggccattccaccatctcagacgacaactacaagacacgatgtatctagacaagtcgactagactaagagtgacgacgacggtcttagttatacgtagtacggaagggacggggatacgnggtgacacgtctacgtaacgtacttacg

SEQ ID NO: 351980 - DNA, 627 bp, Homo sapiens
  misc_feature: GZ8MTXP02I0PK2.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcagtaactacggcgtgcacgtgggtccgccaggctccgaggcaagggcttggagtggctggctagttgtttcatctgaaggtagtgttacaatcctatacagacctccgtagaaacggggtcccgacgttcaacccatcctccgaagacgaactaaacttacccgaaacgaacaacgatacgttaatcgttagacaaagttacggaactaacggacctaaaggaacggtttaggaaggaaccgtaacggtacgtttagtttaacgttaacgtacggtaaacggaaaggggaacgggggtaagtaacggaaggtacgggacgtacggtaccgtaccgtaaacgtttaacgtttaacg

SEQ ID NO: 351981 - DNA, 662 bp, Homo sapiens
  misc_feature: GZ8MTXP02IDWJZ.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagctctcctgtgcaggctctggattcaccttcagtaactacggcgtgcacgtggggtccgcccgagggcctccgaggaccgaaaggggtccgttggggaggtggcgtgggcctaggtttgtttccagttccgttaggtaaaggggtaaagttggtttacaaattacctaattaacacgtacctcccgggtaggaaacggggcccgtaatttccaccctactcctacccaagacgaacctaaacttacccaaagaaaccacgaattagtacttacttagacctaaaagtaggaaccagtaccgtaaaggtaacggttaggaacggacgaacgggtacttagttttagttacgttaggtaaacggtaaagggacgggggtaatacggaaggtcggactacggtactaccgtaacgttacgtttaacg

SEQ ID NO: 351982 - DNA, 573 bp, Homo sapiens
  misc_feature: GZ8MTXP02JM3MK.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggaggtcggtggggggggcgtggtccagccgtgggaggtccctgagactctcctgtgcaggctctggattcaccttcagtaactacggcgtgcacgtcgggtcccgccgaggcctccgaggcgaagggtcgttgggagtggcgtggctagtttgtttacattcgtaggaaggtagttgttacaattactatacagacctcgtaggacggccgtattccacctatcctaccagacgaactaactaccaaagaacacgatagtatcgtagacaaagtgacagactaagagtgagacacgtcttagttatacgaggtaaacggaagggaggggtatacggaaggtacgacgacgtacctacgtaacgttactttacg

SEQ ID NO: 351983 - DNA, 639 bp, Homo sapiens
  misc_feature: GZ8MTXP02HQ322.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggagtccctgagactctcctgtgcaggctctggattcaccttcagtaactacggcgtgcacgtcgggtcccgccgagggcctccgaggcgaaggggtcttgggagtggctggctaggttgtttcatcgtagaaggtagttgttacaaattctaatacagaccgtccgtaggaaacgggcccgtaacttaccaacctactcctacccaagtaacgaacctaaacttacccgaaaacgaaaccaacgtaataggttaactacgttagaacaaaagtacggaacgaacgtaccgtaaagtagttaggaacggacgacggtacttagtttaattaacgtaggtaaacggtaaaagggacgggggtaatacggtaaggtacgacgacggtacctaccgtaaacgttacgtttaacg

SEQ ID NO: 351984 - DNA, 729 bp, Homo sapiens
  misc_feature: GZ8MTXP02GGHNF.8.38.D05.1.454.CMB.2.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccacggagagattgtgttgacacagtctccagccacctgtctttgtctccgaaggggaaancgccaccctctcctgcagggccagtcagagttcgttaccacctagttacgcctaggtaaccaacacaaaccgtggaccaggcctcccacggcccctnattcttgatgcatccatcgacggccacgtggcactcccagccgtaggtttcaggtggctagggtcgggtctaggggacaggtacctttcacttcacaaccattcaaacgcaacgtacctaagacgaccgtaggaaagtttacgttttagactttaagtttaactttactacgttaacctaaaacgttagttacccggtaacccggtaggggttacccgggtcccggggttacccgggggtaccccttaccgggttttacccggggacccccgtttaaacgggggaaaccccttaaaaaggtttaccggaaaacgggtaaccttaaaccgtaaaaacgggtaaacgttcgggtaacgggtccttacggacccttaaccgtaagttccttaacggtttcctaccgttacctttacccgttccccggtaacc

SEQ ID NO: 351985 - DNA, 614 bp, Homo sapiens
  misc_feature: GZ8MTXP02IXABB.8.38.D05.1.454.CMB.2.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
tcagctcgcgtgtccacgaccggtgctcgatttagtatctgatagttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttacgcctggtaccaacacaaactggccaggctcccagcccctnatcttgatgcatccatcgaggccactggcatcccagccaggttcagtgcaggtgggtctgggacngtaccttcnctcncaccatcagcagcctagagcctagaagttattttgacttagtttattactagtactaaactacttaccgtaccgtaggtccgggacccggtcccgggggaccctaccggtttccgggcccgttacgggggtaaaccctaaaagttcggaaacgtactaaccgaaaacgtaaaccgttcggtacgtcgtacgaccctaacctaacgttccgttacgttacctttactacctttcccgtttccccgaccc

SEQ ID NO: 351986 - DNA, 624 bp, Homo sapiens
  misc_feature: GZ8MTXP02GMZYZ.8.38.D05.1.454.CMB.2.raw
  modified_base (300)..(300): a, c, t, g, unknown or other
  misc_feature (300)..(300): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttcctcgttagctctttaagaggtgtccagtgtcaagtgcaactggtggagtcgtggggggggctggtccagccgtgggaggtccctgagactctcctgtgcaggctctggattcaccttcagtaactacggcgtgccacgtcgggtccnccagggcctccgaggccaagggtcttggagtggctggctagttgtttcagtctagaaaggtaagtgttacaaatctaatacaaggacctccgtaggaaacgggccctaattccaacctatccaccaagaaacaactaactaacaaacgaacaacgtatagtactactacgtaacgaagtagaacgaacgaacgtaagtagtaggaacggaacgtacgtacgttagtttaagttaacgtaacggtaaacgggaaacggggaacggggtaaggtaacggtaaggtacggtacgtacgtaccgtaaccgtaaacgttaacgttaacg

SEQ ID NO: 351987 - DNA, 570 bp, Homo sapiens
  misc_feature: GZ8MTXP02IHGR4.8.38.D05.1.454.CMB.2.raw
  modified_base (455)..(455): a, c, t, g, unknown or other
  misc_feature (455)..(455): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagccgtgggaggtccctgagactctctgtgcaggctctggattcaccttcagtaactacggcgtgccacgtggggtcccgccagggcctccgagggcaaggggcttgggagtggctgggctagtttgttcattctaggaaggtaagtgttacaaatctatacagactccgtgaaaggccgattcaccatctacagagacaactacaagaacacgatgtatactagacaaagtganacgactaagagttagagacgaacggtcttagtttagtactaggtaaacggaaagggacgggggtaagtaacgtaaggtaggacgtacggaccgtaccgtaacgttaactttaacg

SEQ ID NO: 351988 - DNA, 536 bp, Homo sapiens
  misc_feature: GZ8MTXP02GX2WI.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgtgtccgccaggctccaggcaagggcttgggagtggctggcagtttgttccatcgtagaaggagtgttacatactatacagactcgtagacggcattcacatctccagagacaataccaagaacacgatagtatctagacaaagtggaacagacctaagagttagagacacggtacttagtttacttacgtagttaacggaaaggagggggaataacgaggtacggacagactacgaacgttaacg

SEQ ID NO: 351989 - DNA, 552 bp, Homo sapiens
  misc_feature: GZ8MTXP02GWOCL.8.38.D05.1.454.CMB.2.raw
  modified_base (300)..(300): a, c, t, g, unknown or other
  misc_feature (300)..(300): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcagtaactacggcgtgcacgtgggtcccnccagggcctccgaggcaagggcttgggagtggctggctagtttgtttcagtcgtaggaaggtagttgtacaatactatacagactccgtagaacggcgtatcacctactctaccagacgaacaacttaccaaagaacacgatgtatctagacaaacgtggaacagtacctaagtagtagacgacgacggtattacgtttatacgtagaacgtaagggaggggtatagaagtgacagctacgacgtacttacg

SEQ ID NO: 351990 - DNA, 631 bp, Homo sapiens
  misc_feature: GZ8MTXP02FXFW4.8.38.D05.1.454.CMB.2.raw
  modified_base (302)..(302): a, c, t, g, unknown or other
  misc_feature (302)..(302): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtggggggggctggtccaggccgtggggaggtccctgagactctcctgtgcaggctctggattcaccttcagtaactcggcgtgcacgtgggtcccnccaggcctccgaggcgaagggtcttgggagtggcgtggctagtttgtttcagttcgtaggaaaggtaagttcgttacaaattacctatacgagtacctccggtaggaaacgggtccgtattcaaccctatcctaccaagtacgactaacttaccaaagaaacacgaatagtactacgtagacaaaagtcggaacacgtaccgtaaaggtagttagaaggacgtacggtacgttagtttaattacgtaggttaaacggaaaacggggtaagggggtaactaacggtaaggtaggacgtacggtacctaaccgtaaacggttactttaacg

SEQ ID NO: 351991 - DNA, 548 bp, Homo sapiens
  misc_feature: GZ8MTXP02FZMTP.8.38.D05.1.454.CMB.2.raw
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcagtaactacggcgtgcactgggtccgccaggctccaggcaagggcttggagtggctggctagttgttcatctgaaggagtgttacaatactatacagactccgtgaaggccgatcacatctcanagacaatacaanaacacgatgtatctagacaaatgaacagacctaaagagttaggagacgacggtacttacgtttattacgtagtaaacggaaagggtaagggggtaataacgaaggtacggacacggtacctaccgtaacgtactttaacg

SEQ ID NO: 351992 - DNA, 660 bp, Homo sapiens
  misc_feature: GZ8MTXP02J2G9C.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcagtaactacggcgtgccacgtgggtcccgccgagggcctccgaggccgaagggcttgggagtggcgtaggctaggttcgttcatcgtagaaggagttgttacaatcctatacagtactccgtagaacgggtccgattccaccatctaccaagagacaacttaccaaagaacacgtatagtatcgtagtacgaaagtacgggacacggtaccgtaaaggtaggtttacggaacgggtaccgtaacggggttacctttaaggttttaacgttaaccgttagggttaaaaccgggtaaaacggggaacggggggttaaacttaaaccggaaggttaccggggaacaaccgggtaccttaacccgtaaaacgggtttaaccttttaacccgg

SEQ ID NO: 351993 - DNA, 569 bp, Homo sapiens
  misc_feature: GZ8MTXP02IF8BC.8.38.D05.1.454.CMB.2.raw
  modified_base (537)..(537): a, c, t, g, unknown or other
  misc_feature (537)..(537): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcggtgggggggctggtccagccgtgggagtccctgagactctctgtgcaggctctggattccaccttcagtaactacggcgtgccacgtgggtcccgccgaggcctccgaggacgaagggtcgttggagtggcgtggcgtagtttgtttacacgtcgtagaaggtagttgttacaaattactaataacacgtacctaccggtggaaacggccgattccacctactctacagacacaactacaaagaacacgatagtactctagacgaagtagacaacgacgtaagtagtagagacacggtcttagtttatacgtagtaacgaaggaggggtanacgaagtggacacgactaccgtagtacttacg

SEQ ID NO: 351994 - DNA, 565 bp, Homo sapiens
  misc_feature: GZ8MTXP02G3GTR.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcagtaactacggcgtgcacgtgggtccgccaggcctccgaggcaagggcttggagtggctggctagttgtttcatctagaaggaagttgttacaatactatacagtactaccggtgaaacgggtcgtagttcacctatcctacagacgacaacttaccaaagaacacgatagtatactagacaaagtagaacagacctaaagacgttaggaggacgacggtacttagtttattacgtagtaacggaaaggacgggggactagaagtggacgacgctacgtaacgtactttaacg

SEQ ID NO: 351995 - DNA, 604 bp, Homo sapiens
  misc_feature: GZ8MTXP02HIAIS.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggcgtggtccagccgtgggaggtccctgagactctcctgtgcaggctcgtggacttcaccttcagtaactacggcgtgccacgtcgggtcccgccaggcctccgaggccgaagggtcttgggacgtggctgggctagttgttcatcgtagaggagtgtacaatctatacagacgtccgtagaaacgggtccgattccaacctactcctacccgaagaacactaaacttacccgaaagaacaacgtatagttactctagacaaagtgaacacgtacctaagagttagaacggtacgacggtattagtttattaacgtaggtaaacggaaacggggtacgggggtaattaacgaaggtaggacgacgtaccgtacgtaaacgtacctttaacg

SEQ ID NO: 351996 - DNA, 593 bp, Homo sapiens
  misc_feature: GZ8MTXP02GNLOQ.8.38.D05.1.454.CMB.2.raw
  modified_base (283)..(283): a, c, t, g, unknown or other
  misc_feature (283)..(283): n is a, c, g, or t
  modified_base (425)..(425): a, c, t, g, unknown or other
  misc_feature (425)..(425): n is a, c, g, or t
  modified_base (463)..(463): a, c, t, g, unknown or other
  misc_feature (463)..(463): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggaggtcggtgggggggggctgggtccaggccgtggggaggtccctgagtactctcctgtgcaggctctggacttccaccttnaagtaactacggcgtgcacgtggcccgcaggcctccgaggcgaagggctgggagtggcgtggctagttgttcatcgtaggaagtagtgtacaaatcgtatacagacctccggagaacggcgtacttcacctatccacaaganaacaactaccaaagaacacgaatgtatctgactaaagnggaacagactaaagagtaggaacggactacggtactttagttaacgttaacgtacgggtaaacggaaaaggggtaacgggggaatacggaaggtacggacgtacggactaaccgtaaagttactttaacg

SEQ ID NO: 351997 - DNA, 644 bp, Homo sapiens
  misc_feature: GZ8MTXP02H9XAJ.8.38.D05.1.454.CMB.2.raw
  modified_base (190)..(190): a, c, t, g, unknown or other
  misc_feature (190)..(190): n is a, c, g, or t
  modified_base (304)..(304): a, c, t, g, unknown or other
  misc_feature (304)..(304): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtncaactggtggagtcgtggggggggctggtccagccgtgggaggtccctgagctctcctgtgcaggctctggacttcaccttcagtaaccgtacggcgtgcacgtcggggtcccnccgaggcctaccgagggacgaaggggtcttgggaggtggcgtggctagtttgttcatctaggaagagttgttacaatactagtacagtacctaccggtaggaaacgccgacttcacctatcctacagacgaactaaacttaccaaagacaacgtagtacttactacgtagactaaaagtacggaaaccaagtaccgtaaaaggacggttaaggaacggtaacggtaacggttacttaggtttttacgttaaaccgtaggtaaaacggaaaggggtaagggggtaactaaggtaaggtaccggaagacggtacgttacccgtaaaggtttaccttaaccgg

SEQ ID NO: 351998 - DNA, 805 bp, Homo sapiens
  misc_feature: GZ8MTXP02IY1R1.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactgggtggagtcgtggggggggcgtggtccagcctgggaggtccctgagactctcctgtgcaggctctggattccaccttcagtaacctacggcgtgcacgtcgggtccgccgaggcctccgaggacgaaggggcgttagggaggtggcgtggcgttagtttgtttaccatcgtaggtaagggtaagttgttaccaaattactataacacgtaccgttacccgggtaggaaacggggtcccgtaacgttacccaaccctacgttacccgttacccgaaaggtaaaccgtaaaccttaaaaccgtttaaccccgaaaaacgggtaaaaccctaaaccggtaagtttaacggtttaaacgttaacccgtttaggaaaccctaaaagggtttacggaaaccgtaaacggtaaccccgttaaaagggtaacggtttagggaaacgggtaccggttaaacccgggttactttaggttttttaaacgttaaccgtttaaagggttaaaaccggggtaaaagggggtaaaccggggggtaagttaaaccggtaaggggttacggaacggtaaccggtacgttaaaacccggttaacggtttaaaccgtttttaaaccgg

SEQ ID NO: 351999 - DNA, 566 bp, Homo sapiens
  misc_feature: GZ8MTXP02IGJJQ.8.38.D05.1.454.CMB.2.raw
  modified_base (298)..(298): a, c, t, g, unknown or other
  misc_feature (298)..(298): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttcagtaactacggcgtgcacgtgggtcccncaggcctccgaggcaagggtcttgggagtggctggctagtttgttcatcgtagaaggtagttgttacaatcgtatacagtactccggtagaaacgggccgacttcacctactctaccagacgaactaacttaccgaaagaacacgatagtatactagacaagtgaacagacctaagagttagagacgacgtacttagtttactacgtaggtaacgaagggacgggggtaatacgaaggtcgacacgtacctacgtaacgtactttacg

SEQ ID NO: 352000 - DNA, 601 bp, Homo sapiens
  misc_feature: GZ8MTXP02IV47T.8.38.D05.1.454.CMB.2.raw
  modified_base (156)..(156): a, c, t, g, unknown or other
  misc_feature (156)..(156): n is a, c, g, or t
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttccncgttgctcttttaagaggtgtccagtgtcaagtgcaactggtggagtcgtgggggggctggtccagcctgggaggtccctgagactctcctgtgcaggctctggtatcaccttnagtactacggctgcactggtccnccaggctaccgaggccaaggggcttaggagtggctggtctagttcgttcagtctggaaggtagtgttcaatacgtatacagtacctcgngaacgggcgagtcacatcncagacgacactacaanaacacgatagtatctagactaagtacggacgaacgaccgtaagtaaggttagacggtacgaacggtaccgttaggtttaacgttaccgtaggttaaaccggtaaagggtaacggggggtaactaaccggtaaggtacgggtacgtaacggaccgttaccggaaaccgtttaacgtttaaacccg

SEQ ID NO: 352001 - DNA, 557 bp, Homo sapiens
  misc_feature: GZ8MTXP02JWL1Y.8.38.D05.1.454.CMB.2.raw
  modified_base (298)..(298): a, c, t, g, unknown or other
  misc_feature (298)..(298): n is a, c, g, or t
  modified_base (370)..(370): a, c, t, g, unknown or other
  misc_feature (370)..(370): n is a, c, g, or t
  modified_base (433)..(433): a, c, t, g, unknown or other
  misc_feature (433)..(433): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattccacctttagtaactacggctgcacgtgggtccnccaggcctccaggcaagggcttgggagtggctggctagttgttcatccgtgaaggagtgttacaatgggtangcagactcgtgaaagggccgattcacatctccagacacaattccaagacacaatgtattggantagaacagacctaagtcctaggagacgacggctactacgtactcggtaaacggaacgggtaacgggggaaccgaggacgggaacgttacgaacggttacctacgtttcgacggtcgtacggggg

SEQ ID NO: 352002 - DNA, 536 bp, Homo sapiens
  misc_feature: GZ8MTXP02FOTOK.8.38.D05.1.454.CMB.2.raw
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcnctctcaccatcagcagcctagagcctgaagtattttgctaagtttattactgtacaacatcgtaccgagtcggccgtccgggggccctacgtttcggcccgtagggaccaaaagttgaagatacaaacgaactgtacggctcgcaccaatctgtcttcacttcctcccgtcc

SEQ ID NO: 352003 - DNA, 557 bp, Homo sapiens
  misc_feature: GZ8MTXP02F2BX9.8.38.D05.1.454.CMB.2.raw
  modified_base (539)..(539): a, c, t, g, unknown or other
  misc_feature (539)..(539): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctggggaggtccctgagactctcctgtgcaggctctggattcaccttcagtaactacggcgtgcacgtgggtcccgccagggcctccgaggcaaaggggcttgggagtggctgggctaggtttgtttcactcgtagaaaggaagtcgttacaatactatacagactccgtagaaggggccgtatcaccatctaccagagacaataccaaagaaacacgaatagtatctagacaaagtagacagacctaagagttagagacacgtctagtttatactaggtaacgaaggaggggtagtaacgaaggtggacgtacncgtacaacgtactttacg

SEQ ID NO: 352004 - DNA, 713 bp, Homo sapiens
  misc_feature: GZ8MTXP02IMGTY.8.38.D05.1.454.CMB.2.raw
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttcgtcgtagcgtctttaagaggtgtccagtgtcaagtgcaactggtggagtcgtgggggggctggtcagcctgggaggtccctgngactctcctgtgcgngctcgtgntctacctctagtaacgtacgcgtcgcacgtcggtccgccgcgccgtccgacggacgaacgggtcggttcggtaggtggtcgtggtcgtagttcgttcgtacgtacgtagtaaggtaaggttagttactaacttacttaactaacgtacgtaccgtaccgtacgggtaacgggtaccgtacgtacctacctacctaccgtaccgaacgaacgtaacctaaacgtaacgtaaaacgaaaccgtaacgtaacgttagttacgttacgtacgtaacgtaaacgtaacgaacgtaaccgtaaccgtaaacgtaacggtacggtaacggtaacgtaacggttacgttacgtttaacgttaacgttaaacggtaaacgggtaaaacggggtaaacgggggtaacggtaacggtaacggtacggtaacgacgtaccgtaaccgttaacgttaaccgtttacg

SEQ ID NO: 352005 - DNA, 722 bp, Homo sapiens
  misc_feature: GZ8MTXP02JLEM4.8.38.D05.1.454.CMB.2.raw
  modified_base (315)..(315): a, c, t, g, unknown or other
  misc_feature (315)..(315): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggaggtcggtggggggggctggtccagccgtgggacggtccctgagtactctcctgtgcgaggctcgtggacttccaccttcaacgtaaccgtacggctgccacgtcgggtcccncacggcctccgaggcgaaggggtcgttgggagttggcgtggtctaggtttgtttacacgttacgtaggaaagggtaagttcgttaactaaacgttacttaaagtaaccgaacggtacccgttacccgggtaaggggaaaccgggtacccgtaactttacccaaaccctacttaccctaccgaacggtaaacgtaacctaaacttaaccgaaaacgaaaccaacggtaatagttaactcgtagaactaaaggtacgaaccgtaagaaccgtaaaggtacggtaggaacggtaacgtacggttacgttagtttacgttaaacgtaacggttaaacggggaaacgggtaacgggggtaactacggaaggtacggacgacgtacgttaccgtaaacggttactttaaccgg

SEQ ID NO: 352006 - DNA, 574 bp, Homo sapiens
  misc_feature: GZ8MTXP02FW9UD.8.38.D05.1.454.CMB.2.raw
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (456)..(456): a, c, t, g, unknown or other
  misc_feature (456)..(456): n is a, c, g, or t
tcagctcgcgtgtccacgaccggtgctcgatttagtatctgataggttggagctctgggagaggagcccagcactagaagtcggcggtgtttccattcggtgatccagcactgaacacagaggactcaccatggagtttgggctgagctgggttttcctcgttgctcttttaagaggtgtccagtgtcaagtgcaactggtggagtcgtggggggggctggtccaggcctgggaggtccctgagactctcctgtgcaggctcgtggattcaccttnagtaactcggcgtgcacgtggggtccnccagggcctccgaggcaagggcttgggacgtggctggctagttgttcatctgaagatgtacaatctatacagtacctccgtagaaacgggcctaattccaccatcctaccaagagacctaattccaaagaaccagaatgtaaattcagacaanagacgagactaagagttagagacgacgtacgtgtttagttacgtagttaacggaaacggaacgggggaaggttaacgtaaggtaggacgacggacgtacctaacggtacgtttaaccg

SEQ ID NO: 352007 - DNA, 575 bp, Homo sapiens
  misc_feature: GZ8MTXP02HZMHP.8.38.D05.1.454.CMB.2.raw
  modified_base (305)..(305): a, c, t, g, unknown or other
  misc_feature (305)..(305): n is a, c, g, or t
  modified_base (546)..(546): a, c, t, g, unknown or other
  misc_feature (546)..(546): n is a, c, g, or t
tcagctcgcgtgtccacgaccggtgctcgatttagtatctgatagttgagctctgggagaggagccccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtggggggggctggtccagccgtgggacggtccctgagactctcctgtgcaggctcgtggatcaccttcagtaactacggcgtgcacgtgggtccnccagggtccaccgaggaccgaagggcttagggagtggctggctagttgttcagtcgtagaaggtaattgtacaatctagtacagactccgtagacgccgatcacatcaccagagacaatacaaacgacacgatagtatctagacaaagtcggaacaagaccgtaaagtagttaggaacggaccgacggtacttagtttattacgtaggttaaacggaaagggacgggggtaatacgaaggngacgagactaccgaaagttacctttaacg

SEQ ID NO: 352008 - DNA, 583 bp, Homo sapiens
  misc_feature: GZ8MTXP02JDJ9S.8.38.D05.1.454.CMB.2.raw
  modified_base (306)..(306): a, c, t, g, unknown or other
  misc_feature (306)..(306): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcgtggggggggctggtccagccgtgggaggtccctgagactctcctgtgcaggctctggacttcaccttcagtaactacggcgtgccacgtcggggtccccnccgagggcctccgagggcgaagggcttgggagtggctgggctaggttgtttcagttcaggaaggtaagtgttacaattctaatacagacctcgtagaacgggccgattcacctatctacaagagacaactaccaaagaacacgtatagtatcagacaaagtaggaacagacctaagagttaggaacggacacggtacttaggtttactacgtaggtaaacggaaagggtagggggaactaggaaggtgacgacgtacgtaccgtaacgtactttacg

SEQ ID NO: 352009 - DNA, 613 bp, Homo sapiens
  misc_feature: GZ8MTXP02H01FG.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtgggggggggcgtggtccagccgtgggaggtccctgagactctctgtgcaggctctggtacttcaccttcacgtaacgtacggcgtgctactggtcgtcccgccgtaggcctcgaggccaaggggtctttgggagtggcgtgggtctaggttgttccatcgtaggaaggtagttgttacatactataccgagtactccggtagacgggccattacacatcaccagacgactaactaccagaaacagtatgtatacagacgtaatggaacacgtaacgtaaggagttaggaacggtaacctgggtaccttttaggttaattaccggtaaggttaaaacggaaggggttaacgggggaattaaccggaggttacggacgtaaggtaccctaacgtaaacgtttaacccg

SEQ ID NO: 352010 - DNA, 609 bp, Homo sapiens
  misc_feature: GZ8MTXP02G5ZKN.8.38.D05.1.454.CMB.2.raw
  modified_base (367)..(367): a, c, t, g, unknown or other
  misc_feature (367)..(367): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtgggggggcgtggtccagccgtgggaggtccctgagactctcctgtgcaggctcgtggacttcaccttcaagtaacctacggcgtgccacgtcgggtcccgcacggcctccgaggcgaagggtcttggagtggctggctagttgttcatcgagaagtagtntacaattactatacacgaccgtacggtagaacgggcccgtataccaccactctaccagagaaccaacttacgaaagacacgatagtatctagacaaagtacgacacgtactaagtagttacgacggtaacgtacggtacgttagttttaacgtaaccgttagggttaacgggaaaacggggtagggggtaactaacggtaaggtacggacgtacgaccgtacgtaacgttacgtttaaccgg

SEQ ID NO: 352011 - DNA, 635 bp, Homo sapiens
  misc_feature: GZ8MTXP02IGUOE.8.38.D05.1.454.CMB.2.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggagtccctgagactctcctgtgcaggctcgtggattcaccttnagtaactacggcgtgcacgtcgggtccnccagggcctccgaggcaagggcttggagtggctggctagttgttcatcgtagaaggtagttgttacaaatctaataacgacgtacctcccggtaggaaacgggtcccgtaacttaccgaaccactactccaagaacgaacctaaattaccgaacggaaacaacaaattagttaagtttaggaagtactaagaacacgtacgtaaacgtcgtaggaacggacgaacgggtacgtaactacgtaacgtacggtaaacgggaaacgggtaacgggggaaaccgaaggacgggtaacgtacgaaacgtaccgttaccgtttacggacgtcgtaccgggg

SEQ ID NO: 352012 - DNA, 609 bp, Homo sapiens
  misc_feature: GZ8MTXP02IZ9T9.8.38.D05.1.454.CMB.2.raw
  modified_base (342)..(342): a, c, t, g, unknown or other
  misc_feature (342)..(342): n is a, c, g, or t
  modified_base (401)..(401): a, c, t, g, unknown or other
  misc_feature (401)..(401): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggctggtccagcctgggaggtccctgagctctcctgtgcaggctctggattcaccttcagtaactacggcgtgcacgtggtccgcaggcctccgaggcgaagggcttggagtggctggctagttgttcntcgtgaaggtagtgttacaatctatacagtaccgtcgtagaacgggccgtacttcaccntactacagagacaacttacaaacgaacacgactagtactctagacaagtacgaacacgtaccgtaaaggtaaggttaggaggaacgacggttacttaggttttaacttacgttaggtaaacgggtaaaacggggtaagggggtaaacgtaacggaagggttacggacggtacgtaccgtaacccgtaacgtttaaccgttttaaccgg

SEQ ID NO: 352013 - DNA, 637 bp, Homo sapiens
  misc_feature: GZ8MTXP02IRWDE.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtgggggggcgtggtccagccgtgggacggtccctgagactctcctgtgcaggctcgtggacttccaccttcaagtaacgtacggcgtgcacgtgtcgtcccgccaggcctccaggcaagggcttggagtggctggctagtttgttcccagtcgtagaaggtagtgttacatactatacgagaccgtccgtagaacgggcccgtattaccaccatccaccgagacgaacaacttaccaaagaaacacgtatacggtaatcgtagaacgtaaagtcggacaacgtaccgtaaaggtacggttaggaacggtaaccgtaacgggttctttaggttttaaacgttaccgtttaagggaaaaccggtaaaacggggtaagggggtaataaacgaaggtcggaccgtacgtaccgtaacccgtaaaagtttaaaccg

SEQ ID NO: 352014 - DNA, 570 bp, Homo sapiens
  misc_feature: GZ8MTXP02F5673.8.38.D05.1.454.CMB.2.raw
  modified_base (271)..(271): a, c, t, g, unknown or other
  misc_feature (271)..(271): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccaggcctgggagtccctgagactctcctgtgcaggctctggattcaccttnagtaactacggcgtgcacgtgggtcccgccgaggcctccgaggcaaggggcttgggagtggcgtggctagttgttcatcgtgaaggtatgtacaatctatacagacctcgtagaacgggcatcacntcncagagacaatacaagaacacgatgtatctagacaaataggaacacggacctaaaggtacggttagaacggacgacggtacgttaggtttaactacgtaggtaaacggaaaaggggtaacgggggaataacgaaggtacggacgacgaccgtaccgtaacgttacttaacg

SEQ ID NO: 352015 - DNA, 683 bp, Homo sapiens
  misc_feature: GZ8MTXP02JKDNW.8.38.D05.1.454.CMB.2.raw
  modified_base (288)..(288): a, c, t, g, unknown or other
  misc_feature (288)..(288): n is a, c, g, or t
  modified_base (401)..(401): a, c, t, g, unknown or other
  misc_feature (401)..(401): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtgggtggagtcggtggggggggctggtccaggccgtggggacggtccctgagactctctgtcgcgagctcgtggcttcacttgagtactcggntcgctacgtcggtccgcgaggcctccgaggccgaagggtcgttagggaggtcggtcgtaggtcttaggtttcggtttacacgttcgtagggacgggtcttaggttacggttanaagttgggtaactcggactacggtaccgtccggtaagggaaaccgggccttaaattcccgaaacctcgttacctaccgaaggaacgtaaccgtaaactccgaaaggaaacctagtaagtagtttaagttagggacgttacgaagaaacgtacggtaccgtaacgtccgaggaacggacgtccgggtattaagaccgtagggtacgaacggggaaacggggtaccggggaacgtaacggtacggtaacgttacccggtaaagtcccgttaggtttcggaacgg

SEQ ID NO: 352016 - DNA, 545 bp, Homo sapiens
  misc_feature: GZ8MTXP02F4PA4.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccaggctccgaggcaagggtctggagtggctggctagttgtttcagttcgtagaaggtagttgtacaatactatacagactccgtagaacggccgtatcaccatctaccagacgactaataccaagaacacgatagtatctgacaatgacagactaagagtgagacacggtacttagttattactaggtaacgtaaagggaagggggataacgaagtacggacacggtactacgtaagtactttacg

SEQ ID NO: 352017 - DNA, 571 bp, Homo sapiens
  misc_feature: GZ8MTXP02IOOY2.8.38.D05.1.454.CMB.2.raw
  modified_base (303)..(303): a, c, t, g, unknown or other
  misc_feature (303)..(303): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggaggtcgtggggggggctggtccagccgtgggacggtcctgagactctcctgtgcaggctctggattcaccttcagtaactacggcgtgcacgtcgggtcccncagggcctccgaggccgaaggggtcttggagtggctgggctaggtttgttcattcgtagaaggtagttgttacaatctatacacgtaccttccggtaggaaacgggtcctattcacctatcctacaagagaactaacttaccaaagacacgtatagtatacgtagacaagtacgacagacctaagagtgagagacgtcttagtttatacgtagtaacggaaggacggggtatacgaagtcggactagactacgtaaacgtactttacg

SEQ ID NO: 352018 - DNA, 581 bp, Homo sapiens
  misc_feature: GZ8MTXP02GEB9U.8.38.D05.1.454.CMB.2.raw
  modified_base (274)..(274): a, c, t, g, unknown or other
  misc_feature (274)..(274): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctcgtggattccaccttnagtaactacggcgtgcactgtcgtcccgccaggcctccgaggcgaagggctttgggagtggctggctagtttgtttccattcgtaggaaggtagttgttacatactatacagtaccgtcggtaggaacgggcccgtattacccgacctactcctacccgagacgaactaaacttaccaaagaacaacgtatagtactcgtagactaaagtcggacagacaagtaagagtagaggtacgacggtcttagtttatacgtagtaacggaaaggagggggaatacgaggtacgacgacgactacgtaaacg

SEQ ID NO: 352019 - DNA, 544 bp, Homo sapiens
  misc_feature: GZ8MTXP02GV9FT.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcagtaactacggcgtgcactgggtcccgccagggcctccgaggcgaaggggcttggagtggctggctagttgtttcatctgaaggagtgttacaatctatacagactccgtagaacgggccattccaacctatctaccagacgacaacttaccaaagacacgatgtatctgacaagtagacagactaagagttgacgactacggtcttagtttatacgtagtaacggaaggacggggatacgaaggtcgacacgtactacaacgtactttacg

SEQ ID NO: 352020 - DNA, 689 bp, Homo sapiens
  misc_feature: GZ8MTXP02I0VVT.8.38.D05.1.454.CMB.2.raw
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggagtcggtggggggggctggtccagccgtgggaggtccctgagctctcctgtgcaggctctggatcaccttcagtactacggcgtgcacgtcgggccnccaggctccgaggcagggtctggagtggctggctaggtttntttcacgttcgtaggaaaggtaagttgttacctaaagtactactaacgagacccgttccggtagggaaacggggtcccgtatttacccaaccctagttaccctaccgtaacgaacgtaaacctaaacgttacccgaaaacgaaaccgtaacgtaaacgttacggttaactacttacgaacctaaaaggtaccggaaacgtaacgtaaccgtaaaggtaacggttagaacgggacgtacggtacctttaggtttaaacttacggttaaggtaaacggtaaaaggggtacgggggtaagttaacggaaggttacgggacacggtacctaaccgtaaacgttacgtttaacg

SEQ ID NO: 352021 - DNA, 631 bp, Homo sapiens
  misc_feature: GZ8MTXP02JPBHB.8.38.D05.1.454.CMB.2.raw
  modified_base (361)..(361): a, c, t, g, unknown or other
  misc_feature (361)..(361): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttcagtaactacggcgtgcactggtccgccaggctccgaggcaagggcttggagtggctggctagttgttcatctgaagtagtgtacaatctanacagactcgtgaagggccgatcaccatctccagacgacaacttaccaaagaacacgatgtatactgactaaagtacggaacacgaaccgtaaaggtaagttaggaacgggacgtaaccgggttacgtttacggtttttaaactttacccgttaaagggttaaaaccggtaaaaagggggtaacggggggggtaaacttaaacgggaacggttaggggaaccgtacggtacccgttaacccgtaaaacggtttaaccgttttaaaacccgg

SEQ ID NO: 352022 - DNA, 765 bp, Homo sapiens
  misc_feature: GZ8MTXP02JREW4.8.38.D05.1.454.CMB.2.raw
  modified_base (261)..(261): a, c, t, g, unknown or other
  misc_feature (261)..(261): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcgtggggggggctggtccagccgtgggacggtccctggagactctcctgtcgcgnggctcgtgacttcaccttgaacgtacgtacggcgtcgctacggtcggtcccgacgacggtcctcggaggtacgaaggggttccttagggacgtcgggcgtacgggtacgttaggtttcggtttaccaagttccggttaaggtaaaaggggtaacgtttcgttaaacctaaagttaccttaacgtaactacggtaacccgtcgggttaacgggaacgggtacccgtaacttacccaaccgttaacgtcccgtacctaaacgggaactaaacccgtaaacgtttaaaccccaaaaggaaacctaaccgttaaacgtgtttaaaccagttacgaaaccgaaggttaacgaaacgaacgtaaccgtaaagggtacgttacggtaaaggacgtaccggttactttacggtttaagttaacgaaacgggtaaaacgggtaaacggggaacggggttaacttaacggaacggtagacggtacgaccgtacgtaacggttacttttaaccgg

SEQ ID NO: 352023 - DNA, 548 bp, Homo sapiens
  misc_feature: GZ8MTXP02GVNH9.8.38.D05.1.454.CMB.2.raw
  modified_base (296)..(296): a, c, t, g, unknown or other
  misc_feature (296)..(296): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggctggtccagcctgggaggtccctgagactctcctgtgcaggctctggattcaccttcagtaactacggcgtgcacgtgggtccnccagggctcccgagggcaaggggcttgggagtggctgggctagttgtttcatctgaaggatgtacaatctatacagtactccgtagaacgggccgattcaccatctccagacgacaatccaaagacacgatgtatctgacaaagtggacagacctaagagttagagacgacggcttagtttattacgtaggtaacggaaagggagggggaatacgaaggtcgacgaggcctaccgtaacgttacgtttaacg

SEQ ID NO: 352024 - DNA, 535 bp, Homo sapiens
  misc_feature: GZ8MTXP02F3UTF.8.38.D05.1.454.CMB.2.raw
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggtttcctcgtagctctttaagaggtgtcagtgtcaagtgcaactggtggagtcgtggggggggctggtccagcctgggagtccctgagctctcctgtgcagctntggattctacctcagtaactacgcgtgcacgtcggccncaggctccgagccgagggcttggagtggcgtggctagttgttcagtctagaagtagttcgtacaatctatacagtactccgtagaacgggctatccactatcgacagacacaataccgaaaanacatatntatnananaanagacagactagtagtagagacgtacgtacgttagttatacgtagtaacggaagggtaacgggaagtagaaggtacggacgacgtacgtacgtaacgtacgtacg

SEQ ID NO: 352025 - DNA, 607 bp, Homo sapiens
  misc_feature: GZ8MTXP02G3LK8.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggaggtcggtggggggggcgtggtccagccgtgggacgtcctgagactctcctgtcgcaggctcgtggacttccgaccttcaagtaacctacggcgtgcacgtcgggtcccgcaggcctccgaggccgaagggtcgttgggaggtggcgtcggcgtagtttcggtttacacgttcgtaggaaaggtagtcgttacaagttactatacagtacctcggtaggaacggccgtatcaccatctacagacgacaacttaccaaagtaacacgtatgtaactacgtagacaaagtacgaacagactaagagttagacggacgacggtacttagtttattaacgtaggtaaacggaaggggtaggggaatacgtaaggtcgacgacgtacctaacgtaacgtacgtttaacg

SEQ ID NO: 352026 - DNA, 579 bp, Homo sapiens
  misc_feature: GZ8MTXP02F6IJJ.8.38.D05.1.454.CMB.2.raw
  modified_base (298)..(298): a, c, t, g, unknown or other
  misc_feature (298)..(298): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagactctcctgtgcaggctctggattcaccttcagtaactacggcgtgcacgtgggtcccncaggctccgaggcaagggcttggagtggcttggctagttgttcatcgtagaaggagtgttacaatctatacagacctcgtagaacgggcctagtacaccatctacgagacgacaattaccaagaacacgactagtatctagactaaagtaggaccagaccgtaagtagttagaacggacgtacggtacttagtttaacttacgttacggtaaacggaaacgggtaagggggaacgtaacgaaggtaggacgaacgaccgtaccgaacgttactttaaccgg

SEQ ID NO: 352027 - DNA, 561 bp, Homo sapiens
  misc_feature: GZ8MTXP02F35DX.8.38.D05.1.454.CMB.2.raw
  modified_base (456)..(456): a, c, t, g, unknown or other
  misc_feature (456)..(456): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcgtggggggggctggtccagccgtgggaggtccctgagactctcctgtgcaggctctggattcaccttcagtaactacggcgtgcacgtcgggtccgccaggcctccgaggcgaaggggcttgggagtggctggctagtttgtttcagtctaggaaggtaagttgttacaatactaatacagtacctccgtaggaacgggcccgtattcacctatctaccagacgacaacttaccaagaacacgatgtatcngacaaagtagacagctaagagtagagacgacgtcgttagttattacgtaggtaacggaaaggagggggatacgaaggtacggacgacgctacaacgtactttacg

SEQ ID NO: 352028 - DNA, 535 bp, Homo sapiens
  misc_feature: GZ8MTXP02GSOQ8.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccgccaggcctccgaggcaagggcttggagtggctggctagttgtttcatctgaaggagttgttacaatctatacagacctcgtagaaagggccattcaccatctaccagagactaattaccaagaacacgatagtatctagacaaatgaacagacctaagagttagagacgacgtactagttattacgtagtaacgaaaggacgggggatacgaagtgacgacgctacaacgtacttacg

SEQ ID NO: 352029 - DNA, 671 bp, Homo sapiens
  misc_feature: GZ8MTXP02IX527.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcactggtggaggtcgtgggggggggctggtccagccgtgggaggtccctgagactctcctgtgcaggctcgtggattcaccttcagtaactacggcgtgcactgtcgtcccgccaggcctcccgaggccgaaggggtctttgggagtgggcctggctaggtttgtttccatcgtaggaaggtagttgttacattactataccagacctcggaggaacgggccgtattccaccactctaccgagacgaactaacttacccaaagaacacgtaattacgtaacttcgtacgactaaaacgtacggaaccgaacgtaaccgtaaaggtaggttaacggaacgggtaaccgtacggggttacctttaaggtttttaaacgtttaacgttaaacggtttaaacggggaaaacggggtacggggggtaaattaaccggagggttacgggacgtacgtacccgttaaccgtaaaacggttttaaaccg

SEQ ID NO: 352030 - DNA, 744 bp, Homo sapiens
  misc_feature: GZ8MTXP02FXP20.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctctttaagaggtgtccagtgtcaagtgcaactggtggagtcggtggggggggcgtggtccagccgtgggaggtccctgagactctcctgtgcaggctcgtggattcaccttcagtacgtacggcgtgcacgtggtccgccgaggcctccgaggcgaagggcgttggagtggcgtggctagtttgttacacttcgtaggaaaggtagttacgttaacaaattacgtaaataaccgaacggtaaccgttccggtaaggaaaccggggtcccgtaacttacccgaacccacttaccgtacccaaagaaacgaacctaaactttaaccccgaaaacgaaaaccgaaaccgtaaagttacggttaaactaccgttacgaacctaaaaggttacggaaacgtaacgtaacccggtaaaggtaacggttaggaaccggtaacgtaaccgggtactttaggttttaaacgttaaccggttaagggttaaaaccgggaaaacgggggtaaacggggggtaagttaaaccggtaaggttacggggaccgtaaacggtaccgtaaccggttaaacgttaaccgttttaaaccg

SEQ ID NO: 352031 - DNA, 562 bp, Homo sapiens
  misc_feature: GZ8MTXP02HZIDL.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggctgcacgtcgggtccgccagggcctccgaggcaagggtcttgggagtggctggctagttgtttcatctagaaggtaagtgttacaattctatacagactccgtagaacgggcccgtattcaccctatcctaccaagacgaacctaattacccaaagaaccagattgtaatctagacaagtagacagactaagagttgagacgacggtcttagtttaacttactaggtaaacggaagggacgggggaatagaaggtggacacgctacaacgttactttacg

SEQ ID NO: 352032 - DNA, 594 bp, Homo sapiens
  misc_feature: GZ8MTXP02H50JJ.8.38.D05.1.454.CMB.2.raw
  modified_base (304)..(304): a, c, t, g, unknown or other
  misc_feature (304)..(304): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcgtggggggggctggtccagccgtgggacgtccctgagactctcctgtgcaggctcgtggattccaccttcagtaactcggcgtgcacgtcgggtccnccaggcctccgaggcaaggggtcttgggagtggctggctaggttgtttcatctaggaaggagttgttacaatctaatacagtacctccggtagaacgggctactcacctatctccaagacgactaactaccaaaacgacaacgtatgtaatctagacaaagtacgacagacctaaggaagttggaacggacgtaacggtcgttagttttaacgttacgtacggtaaacggtaaaggggacgggggtaatacgaaggtgacgtacgaccggtacctaagttaacctttacg

SEQ ID NO: 352033 - DNA, 559 bp, Homo sapiens
  misc_feature: GZ8MTXP02F0FJG.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtggggaggtccctgagactctcctgtgcaggctctggattcacctcagtactacggcgtgcacgtgggtcccgccaggcctccgaggcgaaggggtcttaggaggtggcgtggctagttgtttcatctagaaaggtagtgttacaatctatacagtacctcgtagaggccgatcacatctcagagacaataccaagaacacgatgtatctagacaaagtgaacagacctaagtagtagaaggacgacggtacttagtttacgttacgtaaggtaaacggtaaagggaacgggggataacgaaggtggacacgactacgtaacgtactttaacg

SEQ ID NO: 352034 - DNA, 554 bp, Homo sapiens
  misc_feature: GZ8MTXP02FT56P.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgccacgtgggtcccgccaggcctccgaggcgaagggtcttggagtggctggctagttgtttcatcgtgaaaggtagttgttacaatcctataccagacctccgtagaacgggccgattcaccatctccagagacaattaccaagaacacgatgtatctagacaaagtagacagacctaagagttagagacgacggtcttagtttatacgtagttaacggaagggacgggggatagaaggtacgacgacgactacgaacgtactttaacg

SEQ ID NO: 352035 - DNA, 554 bp, Homo sapiens
  misc_feature: GZ8MTXP02HR43U.8.38.D05.1.454.CMB.2.raw
  modified_base (303)..(303): a, c, t, g, unknown or other
  misc_feature (303)..(303): n is a, c, g, or t
  modified_base (404)..(404): a, c, t, g, unknown or other
  misc_feature (404)..(404): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccattgtcaagtgcaactggtggagtcgtggggggggcgtggtccagccgtgggaggtccctgagactctcctgtgcaggctctggacttcaccttcagtaacctacggcgtgcacgtgggtcccnccaggcctccgaggcaaggggcttgggagtggctaggctaggttgttcatctaggaaggacgttgtcaatctatacagtactcgagaaggccgattcaccntctaccagacgactaactaccaagtaacacgatcgtatctgacaaagtcgacagactaagagtggagacgacggtcttagtttatactaggttaaacgaagggtacggggtaatacggaagtacggcacggctacgaacggtactttacg

SEQ ID NO: 352036 - DNA, 616 bp, Homo sapiens
  misc_feature: GZ8MTXP02JHFP0.8.38.D05.1.454.CMB.2.raw
  modified_base (349)..(349): a, c, t, g, unknown or other
  misc_feature (349)..(349): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggcgtggtccagccgtggggaggtccctgagactctcctgtgcaggctctggattccaccttcagtaacctacggcgtgccacgtgggtcccgccaggcctccgaggcaagggcttggagtggctggctagttnttcatcgtagaaggtagttgtacaatactatacagtaccgtccgtagaaacgggcctattccacctatctacccagacgactaacttacccaaagaaccaacgtatgttaactctagactaaagtgaacacgtacctaaagtagtaggaagacgtacggtacttagtttaaactaccgtaaggtaaacggaaaggggtaacgggggtaactaacgtaagggtacggacgtacggtaccgtaaccgtaaacggtttacctttaaccgg

SEQ ID NO: 352037 - DNA, 606 bp, Homo sapiens
  misc_feature: GZ8MTXP02H4A53.8.38.D05.1.454.CMB.2.raw
  modified_base (572)..(572): a, c, t, g, unknown or other
  misc_feature (572)..(572): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggggctggtccagccgtgggacggtccctgagactctcctgtgcaggtctctggacttcaccttcagtaactacggcgtgcacgtcgggtccgccaggcctccgaggcgaagggtcttgggagtggctggctagttgttcatcgtagaaggtaagtgttacaatactaactaacacgtacgtccgtaggaaacgggtaccgtactacacccactctaccagtaacgactaacttaccaaacgacaacgatagtactactagacctaaagtcggaacgacgaccttaaaggaggttacgaggacgtaacggtcgttagtttaacgttactaggtaaacggtaaagggaaggggagttaacgnggtagacgtacgactaccgagtttaacgttaccg

SEQ ID NO: 352038 - DNA, 569 bp, Homo sapiens
  misc_feature: GZ8MTXP02H1XON.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaagtgcaactggtggagtcgtggggggggctggtccagccgtgggacggtccctgagactctcctgtgcaggctctggacttcaccttcagtaactacggcgtgcatgtgtccgccgaggcctccgaggccaaggggtcttgggagtcggcgtacggctagtttgtttccagttcgtaggaaggtagttgttacatactatacagactcgagaacggcatcacatcaccagacactaataccaaagaacacgtaatgtaacgtctagactaaagtgaacagtacgtaagagtaggacgacgtacgtcttagtttaacttacgtagtaacggaaagggtaagggggtataaggaggtacgacgagtactaccgtaaagttaccg

SEQ ID NO: 352039 - DNA, 598 bp, Homo sapiens
  misc_feature: GZ8MTXP02HARQP.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcgtggggggggctggtccaggccgtggggaggtccctgagactctcctgtgcaggctctggattcaccttcagtactacggcgtgctacgtcggtccgccaggcctaccgaggccgaagggtcttggagtggctggctagttgtttcattcgtagaagtagttgttacaagtactatacgacgtcctccgtagaacgggtcattcaccatccacagacacaacttaccaaagaacacgtaatgtatcagtacaaagtcgaacagaccgtaaggacgttagaaggactaccggtagtttagtttaacttacgtaaggtaaacggaaaaggggaacgggggtaataacggaaggtacggacgtacgtaccgtaccgtaaacgtttactttaaccgg

SEQ ID NO: 352040 - DNA, 614 bp, Homo sapiens
  misc_feature: GZ8MTXP02HA15R.8.38.D05.1.454.CMB.2.raw
  modified_base (581)..(581): a, c, t, g, unknown or other
  misc_feature (581)..(581): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggagtcggtggggggggctggtccagccgtgggacggtcctgagactctcctgtgcaggctctggattcaccttcaagtactacggctagcacgtcgggtccgccgacggctcccgaggcgaagggtcgttgggagtggcgtggctaggtttgtttcagtcgtagaaaggtattgttaacaatactataacacgaccttccggtaggaaacgggtcctagttccaacctatccgtactagaagacctaaacgttaccaaaagaacctaacgattacgtatcttagactaaagtacgaacgtacgacctaaagtagttacggaggtacgaacggtcttagtttattaacgtaggtaaacggaaaggaacgggggtataacgnggtagacacggtactacgaacgttactttaacg

SEQ ID NO: 352041 - DNA, 676 bp, Homo sapiens
  misc_feature: GZ8MTXP02G7UXS.8.38.D05.1.454.CMB.2.raw
  modified_base (314)..(314): a, c, t, g, unknown or other
  misc_feature (314)..(314): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggaggtcggtggggggggcgtggtccaggccgtgggacgtccctgacgctctcctgtgcaggctcgtggacttccaccgttacaagtaactacggcgtcgcacgtcgggtcccnccgaggcctccgaggcgaaggggcttgggagttggctggcttaggtttgtttcatcgtagtaaaggtagtcgttacaatactataccgagtaccgtccgtaggaacgggcctattccacctatcctacaagaacgtactaaacgtaccaaagaaacctaacgattacgtactacgtacgaacgtaaacgtacggaacgacggtaacccgtaaaagtaacggttacggaaaggggaccgttaaccgggttacgtttacgttttaagttaaacgtaagggttaaaacggtaaagggggaacgggggtaacttaacggaaggttacggacgtacggtacctaaaccggtaacgtaactttaacgg

SEQ ID NO: 352042 - DNA, 593 bp, Homo sapiens
  misc_feature: GZ8MTXP02GNIJT.8.38.D05.1.454.CMB.2.raw
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctcgtggattcaccttcagtaactacggcgtgcacgtgggtcccgccagggcctcccgaggccaaaggggccttgggacgtggccttgggcctaggtttgtttccattcgtaggaaaggtaagttgttacaatctanacagacctccgtagaacggcatcaccanctccagagacaatacaaagaacacaatgtatctagacaaatggaactagacctaaagagttagaaggtacgacgtacgttagtttaagttaacgtaggttaaaccggaaaggaaacgggggaattaacgaaggtaggacgacgtacctaaccgaaacgttactttaaaccgg

SEQ ID NO: 352043 - DNA, 611 bp, Homo sapiens
  misc_feature: GZ8MTXP02HDYDB.8.38.D05.1.454.CMB.2.raw
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (575)..(575): a, c, t, g, unknown or other
  misc_feature (575)..(575): n is a, c, g, or t
tcagctcgcgtgtccacgaccggtgctcgatttagtatctgatagttgagctctgggagaggagcccagcactagaagtcggcggtgtttccattcggtgatcagcactgaacacagagactcaccatggagtttgggctgagcttgggttttcctgttgcttcttttaagaggtgtccagtgtcaagtgcaacgtggtggagtcggtggggggggctggtccagccgtgggacggtccctgagctctcctgtgcaggctgtggattcaccttcaagtactacggngtgctacgtcggtcccncagggcctaccgaggacgaagggcttgggagttggccgtggctgtttgtttcaagttctaggaaaggtaagttgtacaaagtctatacagaccgtccgtagaacggggtcctattcacctatctaccgaagtacactaactaccgaaaagaacaacgtatagtatctagaacaaagtaggaacaacgtacgtaaagtagttaggaagtacgaacggtacttaggtttaacttacgtaaggtaaacgaaaacggggtagggggtaataaccgnggtagaccgagtacgtaccgaacgttacgtttaacg

SEQ ID NO: 352044 - DNA, 561 bp, Homo sapiens
  misc_feature: GZ8MTXP02JS54L.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttcagtactacggcgtgcactgtgtcccgcaggcctccaggcaaggggctttgggagtggctggcagtttgttccatctagaaggtagtgtacattacatacagactccgtgaacgggccgattcaccatctccagacgacaattaccaaagaacacgatgtatctgacaaatggacagaccgtaagacgttagacgacgtacggtacttagtttaacttacgtaggtaacggaaaagggagggggaataacggacggtagggacgacgtaccgtacccgtaaaggtttaaccg

SEQ ID NO: 352045 - DNA, 529 bp, Homo sapiens
  misc_feature: GZ8MTXP02FQXG5.8.38.D05.1.454.CMB.2.raw
  modified_base (504)..(504): a, c, t, g, unknown or other
  misc_feature (504)..(504): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagactctcctgtgcaggctctggattcaccttcagtaactacggcgtgcactgggtccgcaggctccaggcaaggggcttgggagtggctgggcagttgttcatctgaaggagtgttcaatctatacagactccgtgaacgggcgattcaccatctaccagagacaattccaaagaaccacgactgtaatctagacaaagtggaacagacctaagacgttgaggtacacggcttagttatacgtagtaacgaaggacgggggatacgngtagcagactaccaagtactttacg

SEQ ID NO: 352046 - DNA, 534 bp, Homo sapiens
  misc_feature: GZ8MTXP02G0T85.8.38.D05.1.454.CMB.2.raw
  modified_base (271)..(271): a, c, t, g, unknown or other
  misc_feature (271)..(271): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttnagtaactacggcgtgcactgtcgtcccgccaggcctccgaggcaaggggcttgggagtggctggcagtttgttccatcgtgaaggagtgttacatactatacagactcgtagaacgggcgattcacatctcagacgacaacttaccaaagaacaacgatagtatctagacaaatgacagcaagagtgagacacgtcttagttattacgtagtacgaaaggtagggggataagaggtaggacgacgactaccgaagtttaaccg

SEQ ID NO: 352047 - DNA, 540 bp, Homo sapiens
  misc_feature: GZ8MTXP02FP2KC.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtggtcccgccaggcctccgaggcaagggcttggagtggctggctagttgtttcatctagaagatgttacaatactatacagactcgtagaacgggccatcacatctacagagacaataccaaagaaacacgaatgtaatctagacaaaatggaacagacctaaagagttagagacacggacttagtttaatacgtagtaaacgaaaagggaagggggataagaagtggacacgctaccaagtacttaacg

SEQ ID NO: 352048 - DNA, 587 bp, Homo sapiens
  misc_feature: GZ8MTXP02JUT8V.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagctctcctgtgcaggctctggattcaccttcagtactacggcgtgcacgtgggtcccgccaggcctccgaggcaaggggtcttgggagtggctggctagtttcgtttcacttcgtagaaggtaagtgttacaattactatacagtacctcggtaggaaacgggccgtattccaccatcctccaagagaacaattacccaaagaacacgatagtatctagacaaagtggaacagaccgtaagagttagagacgacggtcttagtttacttacgtacggtaaacggtaaagggacgggggtaatacggaaggtcggacgacgtaccgtaccgtaaacgttactttaacg

SEQ ID NO: 352049 - DNA, 749 bp, Homo sapiens
  misc_feature: GZ8MTXP02GPUQS.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgacaacgtggtggagtcggtggggggcgtggtccagccgtgggaggtccctgagactctcctgtgcgaggctcgtggtacttccaccttcaacgtaacgtacggcgtgcctacgtcgggtcccgccaggcctaccgaggacgaaggggtcttgggacggtggtcgtggacttagtttcgtttacagttacgtaggaaaaggtagttcgttaacaaacttactaactaaccgaaggtacccgtcccggttaagggaaaccggggtccctaacttacccaaaccctacgtaccgtaccgaacgtaaacgtaaccctaaacgttaacccaaaagaaccaacgtaattacgttaactaccgttaagaacctaaaggtacggaaacctacggtaaccgtaaggtaaggttaccgggaacggtaaccggtacggttacgttttaacggtttaacgttaaaccggttaagggttaaaacggggaaagggggtaacgggggtattaaacgggaagggttacgaacgttacggacccgttaacgtaaaccggtttacttttaaccgg

SEQ ID NO: 352050 - DNA, 568 bp, Homo sapiens
  misc_feature: GZ8MTXP02IAWVS.8.38.D05.1.454.CMB.2.raw
  modified_base (302)..(302): a, c, t, g, unknown or other
  misc_feature (302)..(302): n is a, c, g, or t
  modified_base (524)..(524): a, c, t, g, unknown or other
  misc_feature (524)..(524): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagccgtgggacggtccctgagactctcctgtgcaggctctggattcaccttcagtaactacggcgtgcacgtggggtccnccgaggcctccgaggcgaaggggtcttgggagtggctggctagttgttcatcgtagaaggagttgttacaatactatacagacctcgtagacggccatcaccatctaccagagactaacttacaagaacacgatgtatctagactaagtagacagactaagagttaggagacgacgtacttagtttattaacgtacggtaaacggtaaagggagggggtaanacgtaaggtacggacacggtacctacgtaacgttaactttaccg

SEQ ID NO: 352051 - DNA, 594 bp, Homo sapiens
  misc_feature: GZ8MTXP02FVM0F.8.38.D05.1.454.CMB.2.raw
  modified_base (276)..(276): a, c, t, g, unknown or other
  misc_feature (276)..(276): n is a, c, g, or t
  modified_base (348)..(348): a, c, t, g, unknown or other
  misc_feature (348)..(348): n is a, c, g, or t
  modified_base (515)..(515): a, c, t, g, unknown or other
  misc_feature (515)..(515): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcggtggggggggctggtccagccgtgggacggtccctgacgactctcctgtgcaggctctggattcaccttnagtaactacggcgtgcactgtcgtccgccaggcctccgaggacgagggtcgttggagtggctggctaggttnttccatcgtagaaggtagtgttacatactatacagtcctacggtagaacgggtccgtattacccacctattccacccgaagacgtaactaacttaccgaaagacaacgtatgtactctagaacctaagtacgaacacgtaccgtaaggagttagacggactacggtnttagtttactacgtaggtaaacggaaacgggtggggaataacggtaggtacgacgtacggactacgtaacgtttaaccg

SEQ ID NO: 352052 - DNA, 606 bp, Homo sapiens
  misc_feature: GZ8MTXP02GH4P7.8.38.D05.1.454.CMB.2.raw
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (491)..(491): a, c, t, g, unknown or other
  misc_feature (491)..(491): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcggtgggggggggctggtccagccgtgggaggtccctgagactctcctgtcgcnggctctggattcaccttnagtaactacggcgtgcactgtgtcccgccaggcctccgaggcaaggggtcttgggaggtggcgtggctaggtttcgttccagtctaggaaggtagttggttacaattacctaataccgagtaccttaccggtaggaacggggaccctatttcccaacctatccctaccgaagacgaactaaacttacccaaagaaacacgtatacgtaatcgtanaccaaagtcgaacagacctaaggagttacggaagaccgacgtcttagtttaactagtaagtaacggaaaagggtagggggaataacgaggtacgacgacactaccgaagtttacc

SEQ ID NO: 352053 - DNA, 689 bp, Homo sapiens
  misc_feature: GZ8MTXP02HJE4I.8.38.D05.1.454.CMB.2.raw
  modified_base (206)..(206): a, c, t, g, unknown or other
  misc_feature (206)..(206): n is a, c, g, or t
  modified_base (300)..(300): a, c, t, g, unknown or other
  misc_feature (300)..(300): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgnggggggggctggtccagccgtgggaggtccctgagactctctgtgcaggctctggacttcaccttcagtaactacggcgtgcacgtcgggtccnccagggctccgaggccgaaggggcttggagtggctggctagttgtttcactcgtagaaggtaagttgttacaaacttactaattaacaggaccgttacccgggtaggaaaacgggtcccgtaactttacccgacccgtataccgtacccaagaacgaactaaacgttacccaaaacggaaaccaacggtaaacgttacggttaaacttcgttacgtaacccgtaaaagttacggaaacgacggtaccgtaaaggtagtttaggaacgggtaaccgacgggtaccgtttggttttaaacttacgtacggtaaacggtaaaacgggtagggggtaacttaacggaaggtcgggacgtacgtaccgtaccgtaaacggtttacctttaacgg

SEQ ID NO: 352054 - DNA, 580 bp, Homo sapiens
  misc_feature: GZ8MTXP02ITHJI.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcggtggggggggctggtccaggccgtggggacggtccctgacgactctcctgtgcaggctctggattcaccttcagtaactacggcgtgcacgtcgggtcccgccgaggcctccgaggcgaagggcttgggagtggctggctagttgttcatcgtggaggtagttgtacaatactatacagtaccgtccgtagaacgggccattcaccatctacgagacgaacaactacaaagacacgtatagtatactagactaaagtcgaacacgtaccgtaaagtagttaggacgacgacggtacttagtttagtaccgtagtaaacggaaggaacgggggtatacggaagtaggacgacgactaccgaacgttaactttacg

SEQ ID NO: 352055 - DNA, 709 bp, Homo sapiens
  misc_feature: GZ8MTXP02GE1II.8.38.D05.1.454.CMB.2.raw
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcggtgggggggctggtccagccgtgggacgtccctgacgactctctgtgcaggctcgtggacttcaccttnagtactacggctgctacgtcgggtccncgaggctccgaggcgaagggtcttgggagtcggctgggctagtttgttcatcgtaggtaaaggtattagttaccaagttacctataacgagtacctaccggtagggaacgggcccgtaacttacccgaacctacgtacctacgaagtacgaacctaaacttaccgaaaagaaaccgtaacgtaagttacgtaacttacgtacgaaacgtaaacggtacggaaaccgtaacggtacccgtaaaggtaacggttacggaacgggtaaccgtaacgggttacgtttaacggttttaacgttaacggttaacgggttaaacgggtaaaagggggtaacggggggaacttaaccggtaagggtacggtacgtacggtaaccgtaacgtaaaaccggtttacgtttaaaccgg

SEQ ID NO: 352056 - DNA, 643 bp, Homo sapiens
  misc_feature: GZ8MTXP02HKD5X.8.38.D05.1.454.CMB.2.raw
  modified_base (256)..(256): a, c, t, g, unknown or other
  misc_feature (256)..(256): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggagtcggtgggggggctggtccagccgtgggacgtccctgagactctcctgtgcnggctcgtggattcaccttcagtaactacggcgtgcacgtcggtcccgccgaggcctccgaggtaccgaaggggtcgttgggagtggctggccttagtttcgtttcacgttcgtaggaaaggtaagttgttaccaaattaccgtaattacaacgtaccttccgggtaggaaacgggcccgtaagttacccacctaactcctaccgaagtaacgaaccaaacttaccgaaagaacacgatagtactacgtagaccaaagtaggacagtacctaagtacgttagacgacgtacggtacttagtttagttaacgtacggtaaacggtaaacggggagggggtaactaacggtaaggtacggactacggtacctacgtaacgttactttacg

SEQ ID NO: 352057 - DNA, 669 bp, Homo sapiens
  misc_feature: GZ8MTXP02IZMHM.8.38.D05.1.454.CMB.2.raw
  modified_base (157)..(157): a, c, t, g, unknown or other
  misc_feature (157)..(157): n is a, c, g, or t
  modified_base (305)..(305): a, c, t, g, unknown or other
  misc_feature (305)..(305): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggttttccncgttgctcttttaagaggtgtccagtgtcaagtgcaacgtggtggagtcgtggggggggctggtccaggccgtgggacggtccctgagactctcctgtgcagctctggattcaccttcgagtaacgtacggcgtgcacgtcgggcccncaggcctccgaggccgaagggtcgttagggagtcggcgtggctaggtttcttcagtcgtaggaaagtaagtcgttacaactacgtatacacgtaacgtcccgtaggaaacggggtcccagttaccacctacgtacctaccaagaacaaccgtaacttaacccgaaacgaaacaaccgtatagtaacttaccgtaagaaccttaaaggacgaaacgaccggtaacgtaaaggtacggttaggaaacggtcgtaaaccggttcgttaagtttaccgttaaacgtacggtaaacggaaacgggggtaaaggggtcctaaaggaagggttacgaacgtacggtacctaccgtaacggttacctttaag

SEQ ID NO: 352058 - DNA, 678 bp, Homo sapiens
  misc_feature: GZ8MTXP02GNMIB.8.38.D05.1.454.CMB.2.raw
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcggtgggggggctggtccagccgtgggagtccctgagctctcctgtgcnggctctggattcaccttcagtaacgtacggcgtgcacgtcgggtaccnccgaggcctccgaggcgaagggcgttggagtggcgtgctagttgtttccagttcgtagaaggtaagttgttacaattacgtataacgagtaccgtcgtaggaacgggtccgtattccaccgtactccgtaccaagacgtaactaacgttaacccaaagtaaactaaccgaagttagtaactacctaggtaaccctaaaaggtcggaaaccgtaaggaaccttaaacgggtaagttagggaacggtaaaccgtacggtaaccgtttaggttttaaaccgtaacgttaaagggtaaacggtaaaagggggtaacgggggtaagttaaccgaaggtacgggtactaacgggtaccctaacggtaacgttactttaaccgg

SEQ ID NO: 352059 - DNA, 591 bp, Homo sapiens
  misc_feature: GZ8MTXP02GGJR4.8.38.D05.1.454.CMB.2.raw
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (350)..(350): a, c, t, g, unknown or other
  misc_feature (350)..(350): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagctctcctgtgcnggctctggattccaccttcagtaactacggcgtgcacgtgggtccnccaggcctccgaggccaaggggtcttgggagtggctggctagttgttcattcngaagtagtgttacaatctatacagtactccgtagaacgggccattcacactctacagagacaattaccaaagaacacgatagtatactagacaaagtacggaacacgtaccgtaaaggtagttaggaacggtacgtaacgggtcttacgtttaaagtttacgtaaggtaaacgtaaaaggggtaacgggggattaaacggaaggtacggactacggtactaccgtaacgttaactttaacg

SEQ ID NO: 352060 - DNA, 534 bp, Homo sapiens
  misc_feature: GZ8MTXP02FE3QY.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccaggcctgggaggtccctgagactctcctgtgcaggctctggattccacttcagtaactacggcgtgcactgggtccgcaggctccgaggcaagggcttggagtggctgggcagtttgtttcattctagaaaggagttgttacaatcatacagactcgtagaacgggccgatcaccatctccagagacaataccaagaaacacgatgtaatctagacaaatggaaccagacctaagtagttagagacgacggactagttattacgtagtaacggaaaggacgggggatacgaagtgacagctacaagtcttaac

SEQ ID NO: 352061 - DNA, 571 bp, Homo sapiens
  misc_feature: GZ8MTXP02JY018.8.38.D05.1.454.CMB.2.raw
  modified_base (272)..(272): a, c, t, g, unknown or other
  misc_feature (272)..(272): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttnagtaactacggcgtgcacgtcgggtccgccaggcctccgaggcgaaggggtcttgggagtggctggctagttgtttcatcgtagaaggtaagtgttacaatctatacgacgtactccggtaggaaacgggtccgattccaccatcctaccaagacgactaacttaccaaagacacgatgtatcagactaagtggacacgacgtaagtagtagacgacgaggtcttagttatacgtaggtaaacggaagggaggggtatacggaaggtcggacgtaggacctacgtaacgtactttaacg

SEQ ID NO: 352062 - DNA, 519 bp, Homo sapiens
  misc_feature: GZ8MTXP02FGIZ8.8.38.D05.1.454.CMB.2.raw
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactggggtcccgccagggctccaggcaagggcttgggagtggctggcagtttgtttcatctgaagagtgttacaatcatacagactccgtgaaggcattcacancncagagacaattaccaagaacacgatgtatctgcaaatgacagacctaagagtggagacgaggctagtttattacgtagtaacgaagggaggggatacgaaggtcgacacgctacaacgtacttacg

SEQ ID NO: 352063 - DNA, 599 bp, Homo sapiens
  misc_feature: GZ8MTXP02IRUWI.8.38.D05.1.454.CMB.2.raw
tcagctcgcgtgtccacgaccggtgctcgatttagtatctgatagttgagctctgggagaggagccccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggcgtggtccagcctgggaggtccctgagactctcctgtgcaggctctggacttcaccttcagtaactacggcgtgcacgtcgggtcccgccaggcctccgaggcaaggggcttggagtggcgtggctagttgtttcattcgtagaaaggtaatgttacaatctaatacagacccttccggtaggaaacgggcccgtaattcgaccctatctacccaagacgacaaacttaccgaaacgaacacgtaatagttactacgtagaccgtaaagtcggaacacgacctaaggtacgttaggaacggacgtacggtcttagttttaactacgtagtaacggaaacgggagggggatacgaaggtggcacgctaccgtaacgtacgtttacg

SEQ ID NO: 352064 - DNA, 672 bp, Homo sapiens
  misc_feature: GZ8MTXP02G8257.8.38.D05.1.454.CMB.2.raw
  modified_base (262)..(262): a, c, t, g, unknown or other
  misc_feature (262)..(262): n is a, c, g, or t
  modified_base (340)..(340): a, c, t, g, unknown or other
  misc_feature (340)..(340): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagtctgggttttcctcgttgcttcttttaagaggtgtccagtgtcaagtgcaacgtggtggaggtcggtggggggggcgtggtccagccgtgggacggtccctgagactctcctgtgcgnggctcgtggtacttccaccttcaagtaactacggcgtgcacgtgtcgtccgcgaggcctccgaggcgaggtcttgggngtggcgtggctagtttgtccatcgtagaaggtagtgttacatacttatacgagtaccgtacggtagaaccgggtccgtaacttcccgaacctactaccctacccgaagtaaccgtaaactaaacgttaaccgaaaacgaaccaacgtattacgtacttacgtagaaacgtaaagtaccggaacgtaacgtaccgtaaaaggtaggttacgaaacgggtcgtaaacggttctttacgttaaacgtttaaacgggaacggtaaacggggaaaggggtagggggtaaacttaacggaggtacgtacgaacgtaccgtaaccgtaagtttaacccg

SEQ ID NO: 352065 - DNA, 618 bp, Homo sapiens
  misc_feature: GZ8MTXP02JRRNA.8.38.D05.1.454.CMB.2.raw
  modified_base (252)..(252): a, c, t, g, unknown or other
  misc_feature (252)..(252): n is a, c, g, or t
  modified_base (357)..(357): a, c, t, g, unknown or other
  misc_feature (357)..(357): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctgatccagcctggggacggtccctgagactctcctgngcaggctcgtggacttcaccttcagtaacgtacggcgtgccacgtcgggtcccgccagggcctcccgaggccgaaggggtcttgggagtggcgtggctaggtttnttacccatcgtaggaaggtaattgttacattactataacgagactcggtagaacgggcgtacttcacctatcctaccgagacgaactaaacttaccaaaagactaaaccggtattagtactcctagacgaaagtcggaaacacgactaaggagttaggacggtacgtacggtctttaggtttaactagttaaggtaacggaaaagggtacgggggtaaataagaggtacggacgtaacgtacctacgtaaacgtttaaccg

SEQ ID NO: 352066 - DNA, 652 bp, Homo sapiens
  misc_feature: GZ8MTXP02HJDYE.8.38.D05.1.454.CMB.2.raw
  modified_base (260)..(260): a, c, t, g, unknown or other
  misc_feature (260)..(260): n is a, c, g, or t
  modified_base (312)..(312): a, c, t, g, unknown or other
  misc_feature (312)..(312): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtggggggggcgtggtccagccgtgggacggtccctgagactctcctgtgcnggctctggacttccaccttcaagtaacgtacggcgtgccacgtcgggtcccnccgaggcctaccgagggacgaaggggtcgttagggagtggcgtgggctagtttcgtttcatcgtaggaaggtaagttgttacaattactatacacgtactccgtaggaacggtccacttaccacctactcctaccaagaacgaactaaacttaaccgaaacgtaaacaacgtaattattaacgtactagactaaagtacgacgaagacctaaaggtagttaggaaggaacgtacggtacgttacgtttaagttaacgtaggttaaacggaaaaggggtagggggtaacgtaacggtaaggtcggaacgacgtaccgtaccgtaaacggtttactttaacg

SEQ ID NO: 352067 - DNA, 580 bp, Homo sapiens
  misc_feature: GZ8MTXP02GONKV.8.38.D05.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtgggggggctggtccagcctgggagtccngagctctccngtgcaggctctggattcaccttcagtaactacggcgtgcacgtggtccgccaggcctccaggcgaagggtcttggagtggctggcaggttgtttcatcgtagaaaggagttgttacaatactataacagtactccgagaaagggccgattcacactctccagagacaataccaaagaacacgatagtatctagacaaagtggaacagaccttaaagagttagaaggaacacggacgttagtttaagttacgtaaggttaaacggaaaacggggaacgggggtaagtaacgaaggtacgggacaacggtcctaacccgtaaagttaactttaacgg

SEQ ID NO: 352068 - DNA, 656 bp, Homo sapiens
  misc_feature: GZ8MTXP02JOW0Y.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcggtggggggggctggtccagccgtgggaggtccctgagactctcctgtgcaggctcgtggacttcaccttcagtaaccgtacggcgtgcacgtcgggtccgccgaggcctccgaggacgaaggggtcttgggagtggcgtggctaggttcgtttcagtcgtaggaagtaagtgttaacaattacgtatacgagtacctcggtaggaaacgggtcccgtaattccgaccctagtcctaccgaggaacaacctaaacttacccaaagaaaccacgtaatacgtactacgtacgaacgtaaacgtaggaaccacggaaccgttaaaggtagttacggaacggtacgacggtacgtttagtttaaacgttacgtaggtaaacgggtaaagggtaacgggggtaataacggtaaggtacggacgacgtactaccgtaaacggtttactttaaccgg

SEQ ID NO: 352069 - DNA, 613 bp, Homo sapiens
  misc_feature: GZ8MTXP02FI5FW.8.38.D05.1.454.CMB.2.raw
  modified_base (381)..(381): a, c, t, g, unknown or other
  misc_feature (381)..(381): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggcttagctgggttttcctcgttgctcttttaagaggtgtccagtgtcaagtgcaactggtggagtcgtggggggggctggtccagcctgggaggtccctgagactctcctgtgcaggctcgtggattcaccttcaagtaacctacggcgtgcacgtgggtcccgccaggcctccgaggcaaggggtcttgggagtcgggctggctaggttgttcatctaggaaggtagtgttacaattactanacagtactccgtagaaacggggcctaattcacactctaccagacgaacaattaccaaagaccacgatagtatacgtagacaaagtacggaacacgaccgtaaaggtagttaggaaggacgtacggtacgttaggtttacttaacgtaggtaaacggaaaacggggtaggggggaaactacggaggtaacggacgacggtaccgttaccctaaagttaaccgttacgtttacg

SEQ ID NO: 352070 - DNA, 662 bp, Homo sapiens
  misc_feature: GZ8MTXP02I9EZ6.8.38.D05.1.454.CMB.2.raw
  modified_base (370)..(370): a, c, t, g, unknown or other
  misc_feature (370)..(370): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggagtccctgagactctcctgtgcaggctctggattcaccttcagtaactacggcgtgcacgtgggtccgccaggctccaggcaagggtctggagtggctggctagttgttcagtcgtggaagtagttgttacaattcgtanacagtacctccggtaggaaacggggccctaattccaacccgtatcctaccgaagaaacgacctaaacgttacccaaaaggtaaccaacggtaatacggttaactccttagaaccaaagtcgggaaacctacggaacccgtaaagtaggttacgaacgggaacgtacgggtactttaggttttaactaacggttaccggttaaaacggaaaacgggggtacgggggaacttaacggaacgggttggaacgtaccggtacgttaacccgtaaagggtttaccttttaaaccggg

SEQ ID NO: 352071 - DNA, 591 bp, Homo sapiens
  misc_feature: GZ8MTXP02FNT5G.8.38.D05.1.454.CMB.2.raw
  modified_base (299)..(299): a, c, t, g, unknown or other
  misc_feature (299)..(299): n is a, c, g, or t
  modified_base (549)..(549): a, c, t, g, unknown or other
  misc_feature (549)..(549): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcagtaactacggcgtgcacgtgggtccnccaggcctccgaggccgaagggcttgggagtggctggctagttgtttcatcgtagaaggtagttgttacaaattcgtaataacgagaccgttccggtaggaaacggggcccgattccgaccatactccaagacgaacaattaccaaagaaacacgatagtatctagaccaaagtggaacagaccaaggtagttagaaggacaacgggtcttagtttaattacctaaggtacggtaaaagggagggggtanaacgtaaggtaggacaacggcctacggaacttacgtttaacg

SEQ ID NO: 352072 - DNA, 791 bp, Homo sapiens
  misc_feature: GZ8MTXP02HVA5H.8.38.D05.1.454.CMB.2.raw
  modified_base (173)..(173): a, c, t, g, unknown or other
  misc_feature (173)..(173): n is a, c, g, or t
  modified_base (184)..(184): a, c, t, g, unknown or other
  misc_feature (184)..(184): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagnggtgtccagtntcaagtgcaacgtggtggagtcggtggggggggctggtccgagccgtggggacggtccctggagacctctccgtgtcgcgtaggctcgtaggacttcctacccttcaaacgtaaccgtccggcgttcgccgtacgttcggggccccgaccgacgggcctcccggaggaccgaaggggtcgttagggacggtgggtcgtgggcttacggtttgtttccagtccgtaggaaggtagtgtttaacaaagttctaataacagtaccgtaccggtaggaaacggtccgtaaacttcgaacctacgttacctaccgaagtaacgtaaacctaacttaacccgaaaagaaaccttaacgtacttaggttaaccttacgtaacgtaaacgtaaacgtaccggaaaccgaacggttaaaccgttaagggtaacggttaacggaacggtaacccggtaacggttacttttaaacggtttttaaacggttaaaccggttaaacggggtaaaacggggtaaaacggggggttacggggtaaacgttaaacggggtaagggtacggaaccgtaaccggtaaccgttaaaaccggtttaaaacggtttaaccgtttaaacg

SEQ ID NO: 352073 - DNA, 799 bp, Homo sapiens
  misc_feature: GZ8MTXP02G8N1C.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtggggggggctggtccagcctgggagtccctgagctctctgtgcaggctcgtggtacttcctacccttacgaagtaaccgtacggcgtgccacgtcgggtcccgaccgaggccctaccgaggacgaaggggtcgttgggagtggctgggctaggtttcgttacagttcgtaggaaggtagttagttacaaagttacctaagtaacaagtaccgtaccggtaggaaaccgggaccgtacttacccaaaccctacttaccctacccgaagaacgtaaacctaaacttaaacccgaaaacgaaaacgaaccgtaaaggtttacgtaaattaccgttaaggaaaccttaaaaaggtacgggaaacccgtaacggaaacccggttaaaacggttaaagggtttaacggggtaaaacgggtaaaccgaaaacccgggttacgtttaaaggtttttaaactttaaacccggttaaacgggtttaaaaacgggggaaaaacgggggaaacgggggggtaaacttaaacgggaagggttacggtaaccccggacggtaacccttaaacccggtaaaacggtttaacccgttttaaaacccgg

SEQ ID NO: 352074 - DNA, 783 bp, Homo sapiens
  misc_feature: GZ8MTXP02JV2DF.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgacaagtggtggagtcggtgggggggctggtccagccgtgggacgtccctgacgtactctcctgtgcaggtctcgtggtacttcaccttcgaacgtaacgtacggcgtacgcacgtcgggtcccgccaggccctccgaggtacgaaggggtcttagggacggtggcttggggtcttaggtttcgtttcgattacgtaggtaaggtaaagtttcggttaacaaattacgtaaacgtaaccgtaggtaacccgttaccgggacgggtaaacgggaccccggttaactttaccgaaacccgtaacgttaccctacccgaaacggaacgtaaacctaaacctttaacccgaaaacgtaaacgtaaaccggtaatttaacgttactacgttacggaaacttaaaacggtacggaaccgtaacggtaaccgttaaagggtaaggttacggaaacggtaacgtaccgggttacgtttaacggtttaagttaaccggttaacgggtaaaacgggtaaaagggggtagggggtaacgttaaccgggaagggtacggtacgtacggttaacccggtaacttaaacggtttaacgtttaaccg

SEQ ID NO: 352075 - DNA, 606 bp, Homo sapiens
  misc_feature: GZ8MTXP02IVBPA.8.38.D05.1.454.CMB.2.raw
  modified_base (256)..(256): a, c, t, g, unknown or other
  misc_feature (256)..(256): n is a, c, g, or t
  modified_base (305)..(305): a, c, t, g, unknown or other
  misc_feature (305)..(305): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtgggggggggctggtccaggccgtggggacggtccctgagactctcctgngcaggctctggattccaccttcagtaactacggcgtgcacgtcggtccnccgaggctccgaggacgaagggtcgtggagtggctggctagtttgttacactcgtaggaaaggtagttgttacaaattcgtaatacaacgtacctccggaggaacgggtccgtacttacaaccctactcctaccaagacgactaacttaccgaaaagaaccacgtaatagtactacgtacgacctaaagagaaccgagaccgtaaagagttacgacgacgacggtactgtttaatacgtagtaacggaaaggaagggggtatacggaagtcggacgacgctaaccgtaacgttactttacg

SEQ ID NO: 352076 - DNA, 581 bp, Homo sapiens
  misc_feature: GZ8MTXP02I05GL.8.38.D05.1.454.CMB.2.raw
  modified_base (206)..(206): a, c, t, g, unknown or other
  misc_feature (206)..(206): n is a, c, g, or t
  modified_base (405)..(405): a, c, t, g, unknown or other
  misc_feature (405)..(405): n is a, c, g, or t
  modified_base (429)..(429): a, c, t, g, unknown or other
  misc_feature (429)..(429): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgnggggggggctggtccagccgtgggaggtcctgagactctcctgtgcaggctctggtatcaccttcagtaactacggcgtgcacgtcgggtccgccaggctccgaggccgaagggtctggagtggctggctagttgttcatcgtagaaggagttgttacaagtctaatacagtacctccggtagaaagggccattcaccntctcagagacaattacaagtacanatagtatctagacaaagtcgaacgagtaaccgtaagaaggttagaaggaacgtacggtacgttagtttaacgttactaaggtaaacgtaaaggggacgggggtaataacggtaaggtggtacgacggtactaccgtaacggttactttaacg

SEQ ID NO: 352077 - DNA, 683 bp, Homo sapiens
  misc_feature: GZ8MTXP02GL8ZO.8.38.D05.1.454.CMB.2.raw
  modified_base (266)..(266): a, c, t, g, unknown or other
  misc_feature (266)..(266): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccgagccgtgggaggtccctgacgactctcctgtgcaggctctggtnttccaccttcagtaacgtacggcgtgcacgtgggtcccgccgaggcctccgaggcaaggggtcgttggaggtggcgtggcgtagtttcgttcagtcgtagaaggtagtgttacaatactatacgagtacctacgtaggaacgggcctagttaccaacccgtactacctaccgaacgaacgaacctaaacgttaaccccgaaagaaaccaacggtaaacttagtaactacgttacgactaaaagtacggaaccaacgtaccgtaaaggtaacggttaggaacgggtaacgtacgggtaccgtttagtttaaacgttaacggttacgggtaaaacggtaaaacgggggtaagggggtaactaacggaagggttacggaccgtacgtacccgtaaccgtaacggtttaacctttaaccgg

SEQ ID NO: 352078 - DNA, 668 bp, Homo sapiens
  misc_feature: GZ8MTXP02IEPYR.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgacaacgtggtggagtcggtggggggggcgtggtccagccgtgggacggtccctgagactctcctgtgcgaggctcgtggtacttccaccttcgaagtaaccgtacggcgtgccacgtcggggtcccgccgaggcctaccgaggacgaaggggtcttgggagtcggcgtggctagtttgttcacgtcgtaggaaggtaagttgttaacaagttactataacagtacctccgtaggaacggtccgtacttaccgacctactcctaccgaagaacgaaacctaaacttaacccgaaaagaaaccaacgtaatagtactacgtagaacaaagtcgaacaacgtaaccgtaaaggtaggttaggaacggaacgtacggtacttacgtttaattaaccgtaagggtaaacggaaaaggggtagggggaaactacggaacggtcggaacgtacgaccgtaacgtaaacgtttaacgtttaacg

SEQ ID NO: 352079 - DNA, 579 bp, Homo sapiens
  misc_feature: GZ8MTXP02F00ZJ.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggcgtggtccagcctgggaggtccctgagactctcctgtgcaggctctggattcaccttcagtaactacggcgtgcacgtgggtccgccaggctccaggcaagggcttggagtggctggcagttgtttcatcgtgaaggaagttgttacaatctatacagtaccttccgtaggaaacggggccgacttcaacccatactcccgaagacgactaaacttaccaaagaaacacgatagtatactagacctaaataggacaggacctaagtagttagaacggacgacggcttagtttattacgtagttaacgaaaagggtagggggaagtacgaaggtaggacgacgcgtaacccaagttaccgtttaacg

SEQ ID NO: 352080 - DNA, 525 bp, Homo sapiens
  misc_feature: GZ8MTXP02FGYHN.8.38.D05.1.454.CMB.2.raw
  modified_base (504)..(504): a, c, t, g, unknown or other
  misc_feature (504)..(504): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtcccgccaggctccaggcaaaggggcttggagtggctggcagttgtttcatctgaaggatgttcaatctatacagactccgtgaaacgggccgaattcaccatctccagagacaattccaaagaacacgatgtatctgacaaatgaacagctaagagttgagacaggcttgttattactagtaacgaaaggacgggggatacgaagtcgganacgctacaacgtacgttaacg

SEQ ID NO: 352081 - DNA, 562 bp, Homo sapiens
  misc_feature: GZ8MTXP02H2U19.8.38.D05.1.454.CMB.2.raw
  modified_base (354)..(354): a, c, t, g, unknown or other
  misc_feature (354)..(354): n is a, c, g, or t
  modified_base (526)..(526): a, c, t, g, unknown or other
  misc_feature (526)..(526): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcaagtaactacggcgtgcacgtcgggtcccgccaggcctaccgaggccaaggggtcttggagtggctggctagttgttcatcgngaacgtagtgtacaatctatacagactcgtagaggctatcacatctccagacgacaataccaagaacacgatgtatctgactaagtacgaacacgactaagtagttaggacgacgacggtacttagtttaattacgtaggtaaacggtaaacgggacgggggtaattaacgnggtggactacggactaccgtaacggtacctttaacg

SEQ ID NO: 352082 - DNA, 662 bp, Homo sapiens
  misc_feature: GZ8MTXP02FJ7R1.8.38.D05.1.454.CMB.2.raw
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggaggtcggtggggggggcgtggtccaggccgtgggaggtccctgagactctcctgtgcaggctctggattccaccttnagtaactacggcgtgcctacgtcgggtccnccgaggcctccgaggcaagggtcttgggagtggctggctaggtttgttcagtcgtagaaaggtagtcgttacaatacatacagacttaccgtaggaacgggtctagtcacctagtctccgagacgaacaacttaaccgaaagaaacacgtaagtacgtaagtactacgaaccgtaaaagtaccggaaactacggtaaccgttaaagggtagttacgggaacgtaacgtaaccggttacgtttacgttttaactttaaacggtaacggttaaaacggggaaaggggtaacgggggattaacggaaggtacggtacgaacggtccgttaaaccgtaacgttaccgtttaaaccgg

SEQ ID NO: 352083 - DNA, 672 bp, Homo sapiens
  misc_feature: GZ8MTXP02FLEFP.8.38.D05.1.454.CMB.2.raw
  modified_base (184)..(184): a, c, t, g, unknown or other
  misc_feature (184)..(184): n is a, c, g, or t
  modified_base (192)..(192): a, c, t, g, unknown or other
  misc_feature (192)..(192): n is a, c, g, or t
  modified_base (249)..(249): a, c, t, g, unknown or other
  misc_feature (249)..(249): n is a, c, g, or t
  modified_base (341)..(341): a, c, t, g, unknown or other
  misc_feature (341)..(341): n is a, c, g, or t
  modified_base (474)..(474): a, c, t, g, unknown or other
  misc_feature (474)..(474): n is a, c, g, or t
tcagctcgcgtgtccacgaccggtgctcgatttagtatctgatagttgagctctgggagaggagcccagcactagaagtcggcggtgtttccattcggtgatcagcactgaaccaccagaggactcaccatggagtttgggctgagctgggttttcctcgttgctctttaagaggtgtccagtntcaagtgnaactgtgagtcgtgggggtcgtggtccagccgtgggaggtcccctgagacctctccngtgcaggctctggattcacctcagtaaccacggctgcacgtgggtcccgccaggcctcccgaggcaaggggtcttgggagtcggctcgggcngtttgtttcacttcgtaggaaggaagtcgttacaattacctacacacgtaccgtcgttagaaacgggtcccgtaaacttaccaccctactaccgtacccaaacgacgaaacctaaacttacccaaagaaaccncggaatcgtactctacgacctaaagtacgggtaaccacggtaaccgtaaacggtacggttacggaacgggtaccgtacgggtacctttagtttaaacttaccgtacggtaaaccggtaaaacggggtaacgggggtaacttaaccggaacggttacggaaccacggtaccctaccgtaaaacgttacctttaacccgg

SEQ ID NO: 352084 - DNA, 689 bp, Homo sapiens
  misc_feature: GZ8MTXP02JL1W4.8.38.D05.1.454.CMB.2.raw
  modified_base (454)..(454): a, c, t, g, unknown or other
  misc_feature (454)..(454): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctgttgctcttttaagaggtgtccagtgtcaagtgcaactggtggagtcgtggggggggctggtccagccgtgggacgtccctgagactctcctgtgcaggctcgtggtattccaccttcagtaactacggcgtagcgacgtcgggtccgccgaggcctccgaggcgaaggggtctggaggtcggcgtggctagttgtttcacgttcgaggtaaagacgttgttacaattaccgtaatacgacgtactccgggtaaggacgggtaccctacgttaccaccctactactacccgaagtaanaacctaaacttaacccgaaagaaccaacggattaggttaactcgttacgaacgtaagtacggaaccacgtaccgtaaagtagttcggaaacgtcgaacccggttagttacgttttaaagttaccggttaacggttaaaacgggtaaaagggggtaaccgggggtaacttaaggaaacggttacggacgtaaaccggttaccgtaaccggtaaaacggttaccgttttaaacccgg

SEQ ID NO: 352085 - DNA, 590 bp, Homo sapiens
  misc_feature: GZ8MTXP02I5HDG.8.38.D05.1.454.CMB.2.raw
  modified_base (302)..(302): a, c, t, g, unknown or other
  misc_feature (302)..(302): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggcagtggtccagccgtgggacgtccctgagactctctgtgcaggctctggattcaccttcacgtaacgacggcgtgcacgtcggtccncgagctcgagcgaagggcttgggagtggcgtggctagtttcgtccatcgtaggaaggtagtcgttacagtactaatacagtccgtcggtaggaacgggactattacacatctacagacgactaactacaagacacgtatgtactagtagacaaacgtcgacgaacgtacgtaaagacggttaggaacgacgtacggtcttaagtttaactaacgtaggtaacgtaaaacgggggacgggtaacgtaacggtacggacggaccgtacgtaccgtaacgttaacgttacg

SEQ ID NO: 352086 - DNA, 592 bp, Homo sapiens
  misc_feature: GZ8MTXP02GOJNO.8.38.D05.1.454.CMB.2.raw
  modified_base (399)..(399): a, c, t, g, unknown or other
  misc_feature (399)..(399): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggctggtccagccgtgggaggtccctgagactctcctgtgcaggctctggattcaccttcagtaactacggcgtgcacgtggtccgccaggcctcgaggcaagggcttggagtggctggctagttgttcatcgtagaaggtagttgtacaatctatacagactcgtagaacgggcatcaccatacncagacactaactaccgaaactaacacgtatagtatacgtagactaaagtcggaacagacctaaaggacgttaggacgacgtacgtacgttagtttagttacgtaggtaaacggtaaacggggaagggggtaacgttaaccggaaggttacggacgtacggtaccgttaaccgtaacggttaaactttacccgg

SEQ ID NO: 352087 - DNA, 582 bp, Homo sapiens
  misc_feature: GZ8MTXP02IXS4Z.8.38.D05.1.454.CMB.2.raw
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
  modified_base (444)..(444): a, c, t, g, unknown or other
  misc_feature (444)..(444): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttnagtaactacggcgtgcacgtcggggtcccnccaggcctccgaggccaagggtcttggagtggctggctagttgttcatcgtagaaggattgtacaatctatacagtactcgtagaacgggccatcaccatctccagacgacaattaccaaagaacacgatagtaactaccganaaagtgaacacgtaccgtaaagacgttaggaggacgtacgtacttagtttattaccgtagtaaacggaaacgggtagggggaactaacgaggttaacggacacggtactaccgtaaacggttaccttaacgtttacgg

SEQ ID NO: 352088 - DNA, 581 bp, Homo sapiens
  misc_feature: GZ8MTXP02GW3TS.8.38.D05.1.454.CMB.2.raw
  modified_base (261)..(261): a, c, t, g, unknown or other
  misc_feature (261)..(261): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcgtggggggggcgtggtccagccgtgggaggtccctgagactctcctgtgcaggctntggattcaccttcagtaactacggcgtgcacgtgggtcccgccagggcctccgaggccgaagggcgttggagtggcgtggctagtttgttcatcgtagaaggtagttgttacaatactatacagtactccgtaggaacgggccgattcacctatcctacagtaacgactaattaccaaagaacacgatagtatactagtacaaagtacggactaacgaccgtaaaggtagttaggaaggaacgtacgggtacttagtttattacgtagtaacgtaaaggacgggggatagaaggtgacgagactacgacgttacttaacg

SEQ ID NO: 352089 - DNA, 699 bp, Homo sapiens
  misc_feature: GZ8MTXP02HKH9O.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcggtggggggggcgtggtccagccgtgggagtccctgacgactctcctgtgcaggctcgtggtattccaccttcaagtaaccgtacggcgtgcgaccgtgggtccccgccgagggcctcccgaggaccgaagggtcgttaggaggtcggcgtgggactagtttcgtttcacgtcgtaggaaggtagttgttactaatacgtaactacgagtaccttaccggaggaaacgggtccctaattccaacctactcctacgaagacgaaacctaacttaacccgaaacgtaaaccaacgtaagttacgttaactacgttagaaccgtaaagacggtaaccgagtaccgtaaaaggttaggttacggaaccggtaacgtaacccgggttattaacggtttttaagtttaacggttaacggtaaacgggaaaagggggtaccgggggtaatacggaaggttacggacgtacggtaccttaccgaaaggtttaccgtttaacg

SEQ ID NO: 352090 - DNA, 622 bp, Homo sapiens
  misc_feature: GZ8MTXP02IUCBO.8.38.D05.1.454.CMB.2.raw
  modified_base (296)..(296): a, c, t, g, unknown or other
  misc_feature (296)..(296): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtatcaagtgcaactggtggagtcgtggggggggctggtccagcctgggaggtccctgagactctcctgtgcaggctctggattcaccttcagtaactacggctgcacgtggtccncaggctccgaggcaagggctggagtggctggcagttgttcatcgagaaggtaagtgttacaagtactatacaagactaccgtaggaaacgggcccgtaagttaccaaccctataccgtaccaacgaacgacaaacttaccgaaagaacaacgtaatcgtaatcgtagactaaagtaggaacacgtaccgtaagagttaggaagacgacggtacgttagtttaacgttacgtaggtaaaccgtaaaacggggtaacgggggtaattaaaccggaaggttaacgggacgtaacggtaccgtacccgtaaaaggtaacctttaaaccgg

SEQ ID NO: 352091 - DNA, 561 bp, Homo sapiens
  misc_feature: GZ8MTXP02FQMF6.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcagtactacggcgtgcacgtgggtcccgccagggcctccgaggccaaggggcttgggagtggcgtggcagtttgtttcatctagaaggtatgttacaattactatacagacctccgtaggaacgggccgtacgttcacctatcctaccagacgactaacttaccaagaaacacgatagtatctagacaaagtacgacacgacgtaagagttagaggacgacggtacttagtttattacgtaggtaacgaagggtacggggatacgaagtgacacgctacacgtacttacg

SEQ ID NO: 352092 - DNA, 628 bp, Homo sapiens
  misc_feature: GZ8MTXP02JGRAJ.8.38.D05.1.454.CMB.2.raw
  modified_base (258)..(258): a, c, t, g, unknown or other
  misc_feature (258)..(258): n is a, c, g, or t
  modified_base (309)..(309): a, c, t, g, unknown or other
  misc_feature (309)..(309): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaaggaggtgtccagtgtcaagtgcaacgtggtggaggtcggtggggggggctggtccagccgtgggacgtcctgacgactctcgtgtgcnggctcgtgattcaccttcaagtaacgtacggcgtgctacgtcggggtcccncgaggcctccgaggccgaagggtctggaggtgctggctagttcgttcactcgtagaagtattgtacaatctatacagtacctccggtaggaacggcctataccacctactctaccgagacgacctaacgttaccaaagaacacgtattagtactacgtagaacaaacgtacgaactacggtaacgtaaggtaggttacggaacgtacgaccggttacgtttagttacttacgtacggttaaacgggaaacggggtaagggggtaactaacggtaaggtacggacgtacggtacctaaccggtaacgtttactttaacgg

SEQ ID NO: 352093 - DNA, 613 bp, Homo sapiens
  misc_feature: GZ8MTXP02JHHTZ.8.38.D05.1.454.CMB.2.raw
  modified_base (234)..(234): a, c, t, g, unknown or other
  misc_feature (234)..(234): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccngagactctcctgtgcaggctcgtggattcgaccttcagtaactacggcgtgcacgtcgggtcccgccgaggcctaccgaggccaaggggcttgggagtggctgggcctaggtttcgtttacacgttcgtagaacggagttcgttacaatcctatacgagtacctcggtaggaacgggccgtaacttcacctactctaccaagacaacgaacttaccaaagaacgaacgatacgtatctacgacaaagtagaacgagtacctaagtacgtagaacgacgtacgtcgttagttaagttaccgtaacggtaaacggaaagggtaacgggggtaactaacggaaggtacggtacgacggactaccgtaagtttaccgttaacg

SEQ ID NO: 352094 - DNA, 684 bp, Homo sapiens
  misc_feature: GZ8MTXP02JMZ8F.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcgtggggggggctggtccagccgtgggaggtccctggacgtactctcctgtgcaggctcgtggtacttcgaccttcagtaaccgtacggcgtgctacgtgtcgtcccgcgacggcctccgaggcgaagggtcttgggagtggcctggctaggtttgttcccagttcgaggaaacggtgttcgttaacattactatacgaacgtacgtaccggtaggaaccgggtaccgtatttacccaaccgtacttaccgtaccaagaaccgtaactaaacttaacccgaaaaggtaacctaaacgtattacggttaactcgttaagaaccgtaaaagtaccggaacgtacgtaaccgtaaaggtggttacggaacggacgtacggtacgtttagtttaaactacggttaacgggtaacggaaaagggggtacgggggtaaattaacggacggtacggacacggtaccctaacgttaaacgtttaaccg

SEQ ID NO: 352095 - DNA, 826 bp, Homo sapiens
  misc_feature: GZ8MTXP02HT8MW.8.38.D05.1.454.CMB.2.raw
  modified_base (239)..(239): a, c, t, g, unknown or other
  misc_feature (239)..(239): n is a, c, g, or t
  modified_base (429)..(429): a, c, t, g, unknown or other
  misc_feature (429)..(429): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactgggtgggtgtggggtgggggcgtgtcgacgcggtgggcgtccgngacgtctctcgtgtcgacgcgtctcgtgtctcctacttacaacgtacgtacggcgtcgcgtacggtcggtccgaccgacggtcctacggacggacggacgggtcggtaggtggtcggtcgtggacgtttggtttcgttactattacggtaagggtaaagggtaagtttacgttaaactaaagttacttanaaccgtacgtacccgttacgggaacgggtaaacgggtacccttacttaccaaccgtacttacccgacgaagtaaacctaaacttaaacctaaccgaaaacgtaaacgaacgtagttaacgtttaccttacgttaaacgaaacgtaaacgggtaaccgaaacgtaacccggttaaacgtaaacggggttaaggttaacggggaaccgggtaaaccgggtaacggtttacggtttttaaaacggtttttaaaccgttaaacgggttaaaacgggggtttaaaaaccggggaaacggggggggttaaaaggttaaccgtaacggggttaaggggtaccggaaccgttaccggttacccgttaaaaccggtttaccggtttaaaaccgtttttaaccgggg

SEQ ID NO: 352096 - DNA, 772 bp, Homo sapiens
  misc_feature: GZ8MTXP02IZJUN.8.38.D05.1.454.CMB.2.raw
  modified_base (256)..(256): a, c, t, g, unknown or other
  misc_feature (256)..(256): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcgtggggggggctggtccagccgtgggacggtccctgagactctcctgtgcnggctctggattcaccttcagtaactacggcgtgcactgggtccgccaggcctccgaggcaaggggtctggagtggctggctagttgttcatcgtagaaggtagtgttacaaagtctagtaacaggtaccgtcccgtaggaaacggggccgtacttaccgacctactccttacccgagtaacgtaaccaaacgtttaccgaaaacgaaaccaacggtaaacttacgttaaacgttaccgttagaaaccctaaaagttacgggaaacccgaacggtacccgttaaagggtaaacggttacgggtaaacgggtaaaccggtaaccgggttacggttttaacggtttttaaacgtttaaaccggtttaaacgggttaaaacccgggggttaaaaacgggggtaaaggggggggtaaaccgttaaaacccgggtaagggggttaacggggtaaccggtaaaaccgggtaaccccgtttaacccggaaaaaccggtttttaaccccgtttttaaaacccggg

SEQ ID NO: 352097 - DNA, 744 bp, Homo sapiens
  misc_feature: GZ8MTXP02IBHEP.8.38.D05.1.454.CMB.2.raw
  modified_base (298)..(298): a, c, t, g, unknown or other
  misc_feature (298)..(298): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctcgtggatcaccttcagtaactacggcgtgcacgtggtccncctaggcctccaggcgaagggcttggagtggctggctagttgttcagtcgtagaaggtagttgtacaatcgtattacacgtaccgtaccgtaggaaacgggtcccgtacttaccgaaccacttacctacccgaagtaacggaactaaacttaaacccgaaacggtaaaccaaaccgtaacgttaggttaacttacgttaacgaaacccgttaaaagtacggtaaccgaaacggtacccgtaaaggtaaccggtttaagggaacggaaaccgtaaaccggggttccctttaacggggtttttaaatttaacccggtttaaaaggggtttaaacccgggaaaaacggggttaacggggggggttaaactttaaacggggaaggttaaccggggacggaaaaccggtccgttaaacccggtaaacgtttaaaacccttttaaacccggg

SEQ ID NO: 352098 - DNA, 679 bp, Homo sapiens
  misc_feature: GZ8MTXP02GEL6I.8.38.D05.1.454.CMB.2.raw
  modified_base (243)..(243): a, c, t, g, unknown or other
  misc_feature (243)..(243): n is a, c, g, or t
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtggggggggctggtccaggccgtgggacgtcccngagactctcctgtgcaggctctgattcaccttnagtaacgtacggcgtgcacgtcgggtcccnccgacggctaccgagggccaaggggtcttgggacgtggcgttggactaggtttcgttacagtcgtaggaaaggtagttgtacctaagtactaactacgagtaacctccggtaggaaacgggcccgtattaccgaacctactaccgtaccgaagaacgactaaacgttaccaaacgaacacgtatgtactacgtagaacaagtacgaacgtagacctaaaggtacgttacggaacggtaccgtaacggttacgtttacgtttaaccgttaacggttaaaggtaaacgggtaaaacggggtacgggggtaaacttagggaaccggttaggaccgtaacggtaccgtaaccgtaaacgtttaacgttttaaaccgg

SEQ ID NO: 352099 - DNA, 700 bp, Homo sapiens
  misc_feature: GZ8MTXP02JX4OJ.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagccgtgggaggtccctgagactctcctgtgcaggctctggattcaccttcagtactacggcgtgcacgtggtccgccaggcctccgaggcgaagggtcttgggagtggcgtggctagttgttcacgtctaggaaggtagttgtacaatctatacagtacctaccggtaggaacgggtcccgtagttaccaacccgtaacttcccgtacccgaagtaacgaacctaaacgtttaccccgaaaagtaaccgtaaaccgtaacgttaggttaacttacccgtagtaaacctaaaacggttacgggaaaccgaacggtaacccgtaaaagggtacggtttaggaacgggtaaccgtaaccgggttcgtttaaggtttaaccgtaaccggttaagggtaaacgggtaaaaggggtaacggggggtaattaacgggaaggtacggtacgacggtaccgtaccgtaaacgttaccgtttaacgg

SEQ ID NO: 352100 - DNA, 540 bp, Homo sapiens
  misc_feature: GZ8MTXP02IT2HB.8.38.D05.1.454.CMB.2.raw
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (306)..(306): a, c, t, g, unknown or other
  misc_feature (306)..(306): n is a, c, g, or t
  modified_base (403)..(403): a, c, t, g, unknown or other
  misc_feature (403)..(403): n is a, c, g, or t
  modified_base (451)..(451): a, c, t, g, unknown or other
  misc_feature (451)..(451): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggctggtccagccgtggggacggtccctgagactctcctgngcaggctctggattcaccttnaagtaactacggcgtgcacgtcggggtcccnccaggcctccgagggcgaagggctggagtggctggctagttgttcatcagaaggtaagtgttacaatctatacagtactcgagaacgggcatcacanctcagagactaataccaaagaacacgatagtatactgacaaagtgaanagactaagagtagagacaggtcttagtttaatacgtagtaaacgaacggaggggataagaagtcgacgagtactacaagtactttaacg

SEQ ID NO: 352101 - DNA, 588 bp, Homo sapiens
  misc_feature: GZ8MTXP02FKZTE.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagccgtgggaggtccctgagactctcctgtgcaggctctggattcaccttcagtaactacggcgtgcacgtgggtcccgccagggcctccgaggccgaaggggcttgggagtggcgtggctagtttgtttcatctaggaaaggagttgtactaaatctaataacagactccgtagaaaggggcccgattcaccatctacagagacaaatccaaagaacacgatagtattcctagactaaaacgtaggaacacgacctaaaggaggttagaggacacggtacttaggtttaattacgtaggtaaacggaaaagggacgggggaatacgaaggtacggacgtacgcctaccgtaacgtacgtttaacg

SEQ ID NO: 352102 - DNA, 699 bp, Homo sapiens
  misc_feature: GZ8MTXP02I4WJ2.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggaggtcggtggggggggcgtggtccaggccgtgggacggtccctgagactctcctgtgcaggctcgtggacttcaccttcaagtactacggcgtgcacgtcggtccgccgacggctccgaggcgaaggcgttaggagtggcgtggcgtagtttcgttcacgtcgtagggaggtaagttgtacgaactacgtataacacgtacctccggtaggaaacgggtcccgtaacttaccgaaccctacgtaccgtaccgaagtaacgaacctaaacgttaaaccgaaacgaaaccaacgtagtagttacttactacgaaccgtaaagtagaaccgaacggtaaccgtaaggtaaggttaggaaaccggtaccgtaacggtaccgtttacggtttaaacgttaaccggttaaggtaaaaccgggggtaaaggggtaaacgggggtaacttaacgggaaggttacggacgttacggacccttaacggtaaacgtttacgtttaaccg

SEQ ID NO: 352103 - DNA, 530 bp, Homo sapiens
  misc_feature: GZ8MTXP02FFJM6.8.38.D05.1.454.CMB.2.raw
  modified_base (447)..(447): a, c, t, g, unknown or other
  misc_feature (447)..(447): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggacttcacctcagtaactacggcgtgcacgtggtccgccaggctccgaggcgaagggtcttggagtggctggcagttgttcatcgtagagtagtgtacaatacatacagactcgtagacggctatcacatctacagacgacaataccaagaacacgatgtatcgtagacaaagtgacagactaagngtagagacacggtctagttatactaggtaacgaaagggtacgggggataacgaagtaggacacgtctacgaacgtactttacg

SEQ ID NO: 352104 - DNA, 712 bp, Homo sapiens
  misc_feature: GZ8MTXP02IVNWU.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaagtgcaactggtggaggtcgtggggggggcgtggtccaggcctgggaggtccctgagactctcctgtgcaggctctggattccaccttcagtaacctacggcgtgccacgtgggtcccgccgaggcctccgagggcgaagggcttgggacgtggcgtggcctaggtttgttcattcgtaggaaaggtaagttgttaacaaattactaataacacgtacctcccggtaggaaacgggtcccgtaacgttacccaaccctactaccctaccgaacgaacgactaaacttaacccaaaggaaacctaacgtataggttaactaccgtgaaccaaagttacggaaacgaacgtaaccgtaaaggtacgtttaggaacggtaacgaacggttaccgtttaaggttttaaacgttaaccgttaaacgggttaaaacggggtaaaacggggtaaacggggggtaagttaaaccggaagggttacggacgaacggtacccgtaaccgtaaaacgtttaccgttttaaacccgg

SEQ ID NO: 352105 - DNA, 569 bp, Homo sapiens
  misc_feature: GZ8MTXP02JHOIW.8.38.D05.1.454.CMB.2.raw
  modified_base (364)..(364): a, c, t, g, unknown or other
  misc_feature (364)..(364): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtcggggtaccccgccagggcctcccgaggaccgaaggggtccttaggaggttgggcttgggctagtttcgttanactcgtaggaaggaagttgttacaatactatacacgtacctcgtaggaacggccgatcacatctccagagacaataccaagtaacacgatagtatctagacaagtaggaccagacgtaagagttaggagacgacgtacgttagtttatacgtagtaaacgaacggagggggactagaaggtagcgacgcgtacaacgtacttacg

SEQ ID NO: 352106 - DNA, 737 bp, Homo sapiens
  misc_feature: GZ8MTXP02H06JG.8.38.D05.1.454.CMB.2.raw
  modified_base (305)..(305): a, c, t, g, unknown or other
  misc_feature (305)..(305): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggagtcggtgggggggggcgtggtccagccgtgggaggtccctgagactctcctgtgcaggctctggttcaccttcagtaactacggcgtgcacgtcggggtccnccgaggcctccgaggcgaagggcttgggagtgggctggctagtttgttcatcgtagaacggtagtgttacaaagttactatacgagtaccctccggtagaacggggcctagttcccaacctatccctacccgaagaacgtaactaaacttaacccaaaacggaaacctacggaattacggttaaacttacccgttaggtaaactaaaacggttacgggaaccgaaacggtaccccggtaaaaggtacgggtttagggaaacggtaaccggtaaccgggttaccgtttagggtttttaaaacgtttaccggtttaagggttaaaaccggggaaaacggggtacgggggggtaaagtaaccggtaaagggttaacgggaccgtaacgggtcccttaaaccggtaaacggtttaactttaaccgttttaaccggg

SEQ ID NO: 352107 - DNA, 758 bp, Homo sapiens
  misc_feature: GZ8MTXP02IRLW1.8.38.D05.1.454.CMB.2.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctccagataccaccggagagattgtgttgacacagtctccagccacctgtctttgctccgaggggaaanacgccacctctcctgcagggccagtcagagttcgttacccacctagttacgcctaggtaaccaacacaaacctcggaccacggcctcccacggcccctnacttctttcgatgccactaccatacggacgggcccaacgtcggaccacttaccccgaggtacccgtagggtttaccaggggtcgggccgtaaggggtttcgggggtcctagggggaaacctaggttaccctttaccgtaccttcccgttacccaaacctacgtacccgaaggacccgaacgtacccgttaaggaacgttacccgtaagggtaaaccgttagtttttacgaccgttttaaggtttttaacttaccgttagtacctaaagtaccgttaccggtaacccgggtacggtccccggggacccccgggggtaccgtacccggtttccgggacccgttacgggtaaacctaaagttggaaacgtacgtaaaccgaaacgtacgtacggtacgtacgtacgacctaaccgtactaacggttccttacttacctaccttcccgttacccacttaacg

SEQ ID NO: 352108 - DNA, 732 bp, Homo sapiens
  misc_feature: GZ8MTXP02H789U.8.38.D05.1.454.CMB.2.raw
  modified_base (193)..(193): a, c, t, g, unknown or other
  misc_feature (193)..(193): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaagtncaacgtggtggagtcggtggggggggctggtccaggccgtgggacggtccctgacgactctccgtgtgcgaggtctcgtggtacttccacctttcaagtaaccgtacggcgtgcacgtcgggtccaccgaggctccgaggacgaagggtcgttgggagtggcgtggcctagtttgttcatcgtaggaacggtagttgttaacaaagtactaattacaagtacctccggtaggaaacggccctacgttacacctactacctacccgaagtaacgactaaacgttaacccgaaaacgtaccaacgtaattacggttaactacgtttaacgaaccgtaaaagttacggaaacgaaacgtaacccgttaaaggtacggtttaggaacggtaccgtaacccggttagttaacggtttttaacgttaaaccgttaagggttaaaaccgggtaaaacgggggtagggggtaaacctaacgggtaaggttacggaaaccgtacgggtaacccttaaccggttaaaacggtttacccgtttaaaccgg

SEQ ID NO: 352109 - DNA, 598 bp, Homo sapiens
  misc_feature: GZ8MTXP02HOGT7.8.38.D05.1.454.CMB.2.raw
  modified_base (303)..(303): a, c, t, g, unknown or other
  misc_feature (303)..(303): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagctctcctgtgcaggctctggattccacctttcagtaacctacggcgtgcacgtggggtccccnccagggtcctccgagggacaaggggcttgggagtggcttgggctagttgtttcagtctaggaaggtacttgtaccaatcctatacagtactccggtgaaacgggtccattcaccatcctcagagacaattccaaagaacacgatgtatctagacaagtagacacgaccgtaaagtcggttaggacggacgacggttacgttacgtttattaaccgttaggtaaacgggtaaagggacgggggtaactacggaaggtaggacgtacgacgttaccgtaaacggtttactttaaccg

SEQ ID NO: 352110 - DNA, 804 bp, Homo sapiens
  misc_feature: GZ8MTXP02FWHYI.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaaggaggtgtccagtgtcaagtcgcaacgtggtggagtcggtggggggggctggtccagccgtgggacgtccctgagactctccgtgtcgcgaggcctcgtgggtaacttcctaccttacgaacggtaacccgtacggtccgtagcctaacggttcggggtccccgacccgagggtccctaccggagggtcccgaaggggtccttaggggacgggtcggtccggttgggaccgttaaggtttcgtttaccgaaagttccggtaaggtaaaacgggttaaggttcggttaaccaaaatttaccgtaataaaccggaagttaacccgttcccggtaaggggtaaacgggggtcccgtaaactttcccgaaacccgttacttaccgtacccgaaggtaacgaaccgtaaactttaacccggaaataaaccgtacggtaattacgtaacgttactagtaaccgtaaaaggttacggaaaccacggtaaccgtaaggtacggttaggaacggacgttacggtaccgtttagtttaacgtacgttacgggaaacggtaaaacggggaagggggtaaccttaacggaaggtacgggttaacgaccggtaccggtaaaccttaacggttaaccttttaaaccgg

SEQ ID NO: 352111 - DNA, 545 bp, Homo sapiens
  misc_feature: GZ8MTXP02H0KP8.8.38.D05.1.454.CMB.2.raw
  modified_base (296)..(296): a, c, t, g, unknown or other
  misc_feature (296)..(296): n is a, c, g, or t
  modified_base (507)..(507): a, c, t, g, unknown or other
  misc_feature (507)..(507): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagactctcctgtgcaggctctggattcaccttcaagtaactacggcgtgcactgggtccnccgaggctccaggcaagggcttggagtggctggctagttgtttcatgtagaaggaagttgttacaatctatacagtacctcgtgaaacggccatcacactctccagacgactactacaagacacgatagtatctagacaatagacagacgtaagtagttagagacacggtattagtttacttactaggtaacgtaaacgggacggggtaanacgtaagtacggacacggctacccgtagttacttaacg

SEQ ID NO: 352112 - DNA, 734 bp, Homo sapiens
  misc_feature: GZ8MTXP02GPIE2.8.38.D05.1.454.CMB.2.raw
  modified_base (632)..(632): a, c, t, g, unknown or other
  misc_feature (632)..(632): n is a, c, g, or t
  modified_base (695)..(695): a, c, t, g, unknown or other
  misc_feature (695)..(695): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtggggggggctcggtccagccgtgggacgtcctgagactctcctgtgcaggctcgtggattccgaccttacgagtaaccgtacggcgtcgaccgtaccgtcgggtcccgcccgaggtccctaccgagggaccggaaacggggtcgtttagggacggttgggccgttgggtaccttaggtttggtttccaagttccgtaggtaaaggtaggttgttaaccaaattacctaaataccgaaggttaccgtccggttaaggaaaccgggtacccgtactttacccgaaccctacttacccgacccgaaaggtaacaaccgtaaacttaacccgaaaagtaaaccgacgtaacgtagtaactcgttaagactaaagtcggaacgaagtaaccggtaaaggtacgttaggaacggtaacgtaccggttnttacgttttaacgttacggtaaaggtaaacggaaaagggggtagggggtaacttaaacggggnggtaacgacgtacgaccgtaacgttaacgttacgttacg

SEQ ID NO: 352113 - DNA, 789 bp, Homo sapiens
  misc_feature: GZ8MTXP02JUJJG.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggttgaggtcggtggggggggctggtccaggccgtgggacggtccctgagactctctgtgcgagctctggattcaccttcacgtaactacggcgtcgccacgtcgggtcccgccgagggtcctccggacgggacgtaaacgggggtccgttggggacggtcggggtacgttggggtaccttaaggttttcggttttaccaagtttccggttaaaggggtaaacgggtaaaggtttcggtttaaacctaaaatttaaccgttaaacttaaaccgaacggttaacccgttacccgggggtagggaaaaccgggggtcccgtaaactttacccgaaaccctaacgtacccgttacccgaaaggaacgtaaacctaaaccgtttaacccgaaaaacgtaaacccgtaaccgtaaagttacgttaaaccgttcgttaacgaactaaaacggtacggaaactaacgtaaccgtaaaggtacggttaggaacgtacgtacggttacgttagttaacgttacgtaaggtaaacgggtaaagggacgggggtaatacggtaaggtcggaacacgtacctaacgtaacgttacgtttaacg

SEQ ID NO: 352114 - DNA, 589 bp, Homo sapiens
  misc_feature: GZ8MTXP02I9R55.8.38.D05.1.454.CMB.2.raw
  modified_base (284)..(284): a, c, t, g, unknown or other
  misc_feature (284)..(284): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggaggtcggtggggggggcgtggtccaggccgtggggacggtccctggagactctcctgtgcacggctcgtggtacttcaccttnactacgtacggcgtcgcacgtcgggtcccgccgaggcctccgaggacgaaggggtcgttaggaggtcggcgtaggctagttcgtttacagtcgtagaaggtagttgtacatctanacanactcgtgaggctactcaccntcacagaanaccgtataccgaagaacacgtagtacgtactcgtacgaactaagtacgacgtacgaacgtagtagtacgaggactacgtcttagttatacggtaagaacggtaagggaagggtatacggaaggtaccgagacgtactacgtaacgttacgtttaacg

SEQ ID NO: 352115 - DNA, 764 bp, Homo sapiens
  misc_feature: GZ8MTXP02IP6A1.8.38.D05.1.454.CMB.2.raw
  modified_base (474)..(474): a, c, t, g, unknown or other
  misc_feature (474)..(474): n is a, c, g, or t
  modified_base (598)..(598): a, c, t, g, unknown or other
  misc_feature (598)..(598): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtgggttttcctcgttgcttcttttaaggaggtgtccagtgtcaagtgcaacgtgggtggaggtcggtgggggggggccgtgggtccgaggccgtgggggtaccgtccgtgacgtctcctccgtggtcgcgacggtctggtcgttactccctacctacgtaacgtaaccgtacggtcggtcgccgtacgggtcccgggtcccgaccggtaccggtcccgtacggacgggacggtaagggtcggttagggtcgggtcggtcggtacggttacgtttgtttgttacgtactcggtaaggtaacggtagtttcgtaaacctaatacgttaanaaccgtacgtaccgttaccgggaagggaccggtcctactcccaccttactccaaccgtaagtaactaaccttaaaccgtaaaccgaaaacgtaccgaattagttacttccttaagaacgtaaanaacgggtaccgaaacgtacgtaaaccgttaagggtacggttaacgaccgggtaaccggtttaccgttaaagttttacgttttaacgtacggtaaaacggggttaaaggaaacggggtaggtaacgtacgaaggtcgactcgtaactacgttaacgttactttacgg

SEQ ID NO: 352116 - DNA, 537 bp, Homo sapiens
  misc_feature: GZ8MTXP02FKW4K.8.38.D05.1.454.CMB.2.raw
  modified_base (457)..(457): a, c, t, g, unknown or other
  misc_feature (457)..(457): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtcccgccagggcctccgaggcaaggggcttggagtggctggctagttgtttcatctgaaggtagtgtacaatctatacagactccgtagaacgggccgtatcaccatctcagagactaattactaagaacacgatagtatctagacaaatggacagactaagngtagagacacggtcttgttatacgtagtaacggtaaaggacgggggatacgaaggtgacgacgactaccaagtacttacg

SEQ ID NO: 352117 - DNA, 510 bp, Homo sapiens
  misc_feature: GZ8MTXP02GSYGR.8.38.D05.1.454.CMB.2.raw
  modified_base (293)..(293): a, c, t, g, unknown or other
  misc_feature (293)..(293): n is a, c, g, or t
  modified_base (359)..(359): a, c, t, g, unknown or other
  misc_feature (359)..(359): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagatctctgtgcaggctctggatcgaccttcagtaactacggcgtgcactgggtccncaggctccgaggcaagggtcttggagtggctggcagttgttcatcgtgaagactgttacaatctanacagacctcgagacgccatcacancganagtacactaatacgaaanacatatnatacanacaacgagacacacgtaagagtagagacgacgtctagttatacgtagtaacgaaggaacggaagacgaagtacgacacacacaactactacg

SEQ ID NO: 352118 - DNA, 777 bp, Homo sapiens
  misc_feature: GZ8MTXP02I3KSX.8.38.D05.1.454.CMB.2.raw
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcggtggggggggctggtccaggccgtgggaggtccctgacgactctctgtgcaggctgtggattcgaccttcagtaactacggcgtcgcgacgtcgggtcccgccaggctccgaggcgaaggggtctgggagtggcgtggctaggttgtttccagttcgtagaaaggtagttgttacaaactacgtaatacgacgtaccgtcccggtaggaaacgggtccgtaacttaccaacccgtacttccgtacccgaagaacgtaacctaaaacttacccgaaaacgtaaacccgaacgtaaacgttacgttaactacgttaacggaaccctaaaaggttaccggaaaccgtaacggtaaacccgttaaagggtaaggtttacggaaacgggtaaaccgtaacccggtttacgtttaggtttttaaaccgtttaaaccggtttaaacgggttaaaaacgggggtaaaaacggggggttaaaggggggtaaacgtttaaaccgggaaggggtttacggggaacgtaaccggttaacccggttaaaccgttaaaacgggtttaaccgtttttaaacccggg

SEQ ID NO: 352119 - DNA, 709 bp, Homo sapiens
  misc_feature: GZ8MTXP02JVA44.8.38.D05.1.454.CMB.2.raw
  modified_base (305)..(305): a, c, t, g, unknown or other
  misc_feature (305)..(305): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggaggtcgtggggggggctggtccagccgtgggacggtccctgagactctcctgtgcaggctctggacttcaccttcagtaactacggcgtcgcacgtcgggtccnccaggtcctcccgaggaccaaggggtctggagtcggcgtaggctaggttcgttcatcgtggaaaggtagtgttacaaactacgtaacttaacgacgtaccgtccggtaggaacgggtccgagtttaccacctataccgtacaacgaacgtaacctaaacttaaccccgaaagaaacgtaaccgtaaagttacggtaactaccgtagtaaaccctaaaaggttaccggtaaacgaaccggttaacccgtaaaacggtaaggttacggaacgggaacgtaacggttaccgtttagtttaaaccgttaccgttaaagggtaaacggtaaaaggggtacggggggtaacttaacggaaggttacggacgtaacggtacctaacggtaaacgtttaccgtttaaaccgg

SEQ ID NO: 352120 - DNA, 697 bp, Homo sapiens
  misc_feature: GZ8MTXP02IBFLG.8.38.D05.1.454.CMB.2.raw
  modified_base (357)..(357): a, c, t, g, unknown or other
  misc_feature (357)..(357): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctctttttaagaggtgtccagtgtcaagtgcaactggtggagtcggtgggggggggctggtccagccgtgggaggtccctgagctctctgtgcaggctcgtggattcaccttcaagttaacctaccggcgtgcctacgtgggtcccgccgaggctccgaggcgaagggtcgttggagtggcgtggctaggttcttnactcgtaggaaagtacgtgttacaagttctaattacacgtacgtccgtaggaacgggtacccgtacttaccgaccctactacctacccgaacgtaacaaacgtaaacttaaccgaaaaccgaaacctaaccgtagttacggttaactacgttacggaacctaaaaggtcggaaacgaacggtaacccgtaaaaggtacgggtttacggaacgggtaccgaacggttcctttaggttttaaacgttaaacgttaagggttaaaaccggtaaaacgggggaacgggggtaagtaacggtaaggtcggacgtacgtaccgtaccgtaaacgttacgtttaacg

SEQ ID NO: 352121 - DNA, 638 bp, Homo sapiens
  misc_feature: GZ8MTXP02IFROY.8.38.D05.1.454.CMB.2.raw
  modified_base (215)..(215): a, c, t, g, unknown or other
  misc_feature (215)..(215): n is a, c, g, or t
  modified_base (436)..(436): a, c, t, g, unknown or other
  misc_feature (436)..(436): n is a, c, g, or t
tcagctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcgtgggggggngtggtccagccgtgggaggtcctgagactctcctgtgcaggctctgattcaccttcacgtaactacggcgtcacgacgtcggtccgccaggctccaggcaagggcttaggagtggcgtggctagttgttcactcgtagaacggtagtgttacaaatactataacacgactccgtaggaacgggtcatacacctactctccaagacgacaaactaccgaaanaaccgactaacgtagtaactacgtactacaaaagtacggaacaacgtacccgtaaaggtacgttagggaacggaacgtacggtacgttacgtttaaattacgtttaacggtaaacggtaaaacggggtaacggggggtaaagtaacccggtaaggtaggtacccgtaagtacccgttaacaaacggtttaccgtttaaaccg

SEQ ID NO: 352122 - DNA, 536 bp, Homo sapiens
  misc_feature: GZ8MTXP01C36JL.52.58.F03.1.454.CMB.2.raw
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtcctgcatctgtaggagacagagtcaccatcacttgccgggcaagtcagagcattggacaaatattaaatgatcagcaagaaccaggaaacncctanactctnatntatnctctctactattnacagtgcgtcccactgtgtcgagtcggcgggcgtcgtggacgacgtactctactctacacactacacgtcgtctactactacgtacgtacgttacgtaacttactactacgtactacgacagagtagtactaactacctactacgtacgttccgtccgtaacggtacgttacgtagttagtagtacgttacgttaacgttacgtaagtgtcgtcgtcttactaacttcgtcg

SEQ ID NO: 352123 - DNA, 539 bp, Homo sapiens
  misc_feature: GZ8MTXP01A2QB8.52.58.F03.1.454.CMB.2.raw
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggacacagagtcaccatcacttgccgggnaagtcagngcattgcaaatattaaatgatcancagaaacaggaaacgccctagactcctgatctatgctgcctcctaatttgactaaagtgccgtcccccatcgaggttcaggttacgggcccggggtaatcgtggggacagacttcactctcaccatcagcgtcttacaacctgacgtacttaggaactttactacgtcggtacacgtacagtagtagtaactaacctaccctagtacgttaccgttccggccgtaaggaccttagtaggttgtatacgttaacgaacgttagtgtgtcncncactaacgttcgtg

SEQ ID NO: 352124 - DNA, 722 bp, Homo sapiens
  misc_feature: GZ8MTXP01CC8WK.52.58.F03.1.454.CMB.2.raw
  modified_base (275)..(275): a, c, t, g, unknown or other
  misc_feature (275)..(275): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggacaaatatttaaatggtatcagcagaaaccagggaacncccctagactcctgatctatgctgcccttccaatttgacaaagtggccgtcccccagtcgagttccaggtcgggcccgggggtaatcgtaggggaactacggtacctttacaaccttcttacccaacccgtaactttccgaacgggttcccggggtttacccttttaacccgaaaccccgtttagggtaaccggggttaaccgtttttacggggtaaaacccttttaccgtaacccgtttgggggttaccctaagggacccgtaagggtaaggtacgtaaacttaaaccgttacccccctagtaaccggttaacccgttttcccgggaccccgttaaggggtaaccccttacgtacgggttacgggtaaattcggttaaacccgaaaacggttacccgttgggtcgggtaaccttcgggacccttaacccgttcgtttccgttaacg

SEQ ID NO: 352125 - DNA, 570 bp, Homo sapiens
  misc_feature: GZ8MTXP01DAQ6K.52.58.F03.1.454.CMB.2.raw
  modified_base (271)..(271): a, c, t, g, unknown or other
  misc_feature (271)..(271): n is a, c, g, or t
  modified_base (351)..(351): a, c, t, g, unknown or other
  misc_feature (351)..(351): n is a, c, g, or t
  modified_base (474)..(474): a, c, t, g, unknown or other
  misc_feature (474)..(474): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctcctgtctgcatctgtaggagacagagtcaccatcacttgccgggcaagtcagagcattggacaaatattaaatgtatcagcaagaacaggaaacnccctagactcctgatctatgctgccctcaatttgactaaagtggccgtccccagtcgaggttcaggtcgggacccgggtntcgtcggggactacggacctttacactccttacaacctatacgacgtcggttactacgtaaaccgtgacggtactttacggaacttactacgtgtacgagacagagtagactaactacccctntacgtaccgtttcggcccgtgggtacttacgagttggtaatcgttaacgaacgttaacgtggttcgcgttcggacttaccctaagttccgtttccg

SEQ ID NO: 352126 - DNA, 589 bp, Homo sapiens
  misc_feature: GZ8MTXP01B81OL.52.58.F03.1.454.CMB.2.raw
  modified_base (285)..(285): a, c, t, g, unknown or other
  misc_feature (285)..(285): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggacaaatatttaaatgatcagcaagaaacaggaaacgccctagactccngatctatgctcgcctacctaatttgacaaagtcggaccgtaccccccagtcgtaggtttccaaggttcggggacccggggtaatcggtagggggaacctacggtaccttcactcctaccaacctatccgagtccggtacttaccaaccgtggaacggtactttacggaacttactactaggtcagcaagatagaactaaactacccctgaacgtaccgtttccgcccgttaacgggacttaacgagttcggattacggttaacgaaaccgagtaagtcggtaactggaccacctaattcgttcg

SEQ ID NO: 352127 - DNA, 539 bp, Homo sapiens
  misc_feature: GZ8MTXP01CHLM7.52.58.F03.1.454.CMB.2.raw
  modified_base (271)..(271): a, c, t, g, unknown or other
  misc_feature (271)..(271): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctcctgtctgcatctgtaggagacagagtcaccatcacttgccggcaagtcagagcattggcaaatattaaatggatcagcagaaaccagggaaacnccctagactcctgatctatgctgccctacaatttgactaaagtcgaccgtcccccatcgagttcgacggtgggcccggggaatcgtaggggactaggacttcactctcacatcagcgtcttacaacctgagtacttagaacttactactgtcaggtcagtagtanataacttaccccntaagtaccgtttccggcccgtaagggacttacgtagttcggaatcggttacaaacgttactgtacggcttcggcttacgtaacttcttcg

SEQ ID NO: 352128 - DNA, 487 bp, Homo sapiens
  misc_feature: GZ8MTXP01BIKWK.52.58.F03.1.454.CMB.2.raw
  modified_base (362)..(362): a, c, t, g, unknown or other
  misc_feature (362)..(362): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
tcagcgcagtacgacacgaccggtgctcgatttagtctgatcgagaagggaaaggggagtcagtctcagtcaggacacagcatggacatgagggtccccgctcagctcctggggctcctgctactctggctccgaggtgccagatgtgacacccacgatgacccagtctccgatcctcctgtctgcatctgtagagacagagtcaccatcacttgccggcaagtcagagcatgacaaatattaaatgatcagcaagaaccaggaacgcccctagactcctagatctatgctgcctcaatttgacaagtgctccccatcgagttcaggtgggccgggaatcgtagggactagacttcacttcncacatcagcgtcttacgactgacgtacttgaacttactactggtcagcagagtnatactaccctntagtacttcggcctggtacttcgagttgaatgttacaacgatgngctgcacctnttcgtg

SEQ ID NO: 352129 - DNA, 588 bp, Homo sapiens
  misc_feature: GZ8MTXP01CPLCI.52.58.F03.1.454.CMB.2.raw
  modified_base (230)..(230): a, c, t, g, unknown or other
  misc_feature (230)..(230): n is a, c, g, or t
  modified_base (276)..(276): a, c, t, g, unknown or other
  misc_feature (276)..(276): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctcctgtctgcatctgtaggagacagagtcaccatcacttgccgggcaagtcagancattggacaaatatttaaatggatcagacaagaaaccagggaaacncccctagactcctagatctatgctgcccttacaatttgacaaagtgcgtacccccatcgtagttcaggtcgggccgggtaatcgtgggaacagtaccttcactctcaaccatacgagtccggttacttacaaaccgtgaggtacttaggaacttactacgtgtacagtacagtagtagaacttaactacccctgtacgtaaccgtttccgggcccttaaggggaacttacgtaggttgggtaaacttcgttaaaccgaaaacgttaccgttggttcggaacttcggacttacccttaagttcccgtttaacg

SEQ ID NO: 352130 - DNA, 555 bp, Homo sapiens
  misc_feature: GZ8MTXP01BGOZR.52.58.F03.1.454.CMB.2.raw
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (232)..(233): a, c, t, g, unknown or other
  misc_feature (232)..(233): n is a, c, g, or t
  modified_base (250)..(251): a, c, t, g, unknown or other
  misc_feature (250)..(251): n is a, c, g, or t
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (346)..(346): a, c, t, g, unknown or other
  misc_feature (346)..(346): n is a, c, g, or t
  modified_base (432)..(432): a, c, t, g, unknown or other
  misc_feature (432)..(432): n is a, c, g, or t
tcagcgcagtacgacacgaccggtgctcgatttagtctgatcgagaaggggaaagggggagtcagtctcagtcaggacacagcatggacatgagggtccccgctcagctcctggggctcctgctactctggctccgaggtgccagatgtgacacccagatgacccagtctccatccctccctgtctgcatctgtaggagacagatcaccatcacttgccggganagtnagannatgataatattaatgannanacaagaacgaggaacnccanactcnatctatnctcacctactaattgacaaagtcgacctaccccagtacgtaggtcaggtacgggaccgggngtcggtacgggacacgtactacactcacactatacacgtcgtctactactagtacgtacgttacgtaacttactactacgtcaganagagtagtaactaactaaccctactacgtaccgttccgtccgtaacggtacgttacgtacgttaggtagtacgttaacgttaaacgttaacgtaagtcgtcgtcgtacactaacgttcgttcg

SEQ ID NO: 352131 - DNA, 510 bp, Homo sapiens
  misc_feature: GZ8MTXP01BTX9R.52.58.F03.1.454.CMB.2.raw
  modified_base (338)..(338): a, c, t, g, unknown or other
  misc_feature (338)..(338): n is a, c, g, or t
  modified_base (433)..(433): a, c, t, g, unknown or other
  misc_feature (433)..(433): n is a, c, g, or t
  modified_base (494)..(494): a, c, t, g, unknown or other
  misc_feature (494)..(494): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacaccagatgacccagtctccatcctcctgtctgcatctgtaggagacagagtcaccatcacttgccgggcaagtcagagcattggcaaatattaatgatcagcaagaaaccaggaacgccctagactcctgatctatgctgcctacaatttgacaaagtggctccccatcgagttcagtgggccgggntcgtgggacagacttcactctcacatcacgtcgtcttacaaccgttgacgtactttagaacttactactggtcagcagtatgaataactaccctntacggtacctttcggccctgggacttacgagttggatgttacgaaacgttaactgtggctncttaccaattcgttcg

SEQ ID NO: 352132 - DNA, 520 bp, Homo sapiens
  misc_feature: GZ8MTXP01CLYMW.52.58.F03.1.454.CMB.2.raw
  modified_base (274)..(274): a, c, t, g, unknown or other
  misc_feature (274)..(274): n is a, c, g, or t
  modified_base (346)..(346): a, c, t, g, unknown or other
  misc_feature (346)..(346): n is a, c, g, or t
  modified_base (372)..(372): a, c, t, g, unknown or other
  misc_feature (372)..(372): n is a, c, g, or t
  modified_base (438)..(438): a, c, t, g, unknown or other
  misc_feature (438)..(438): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggactaaatatttaatgatcagcaagaaaccaggaaacnccctaagactcctgatctatgctgcctcaatttgacaaagtgacgtccccatcgagttcagtcgggccgggntcgtgggacacgactcactctcactntcagcgttctacaacctgacgtacttaggaacttctaactggtacagcagatgaataactaccctntagtaccttcggccctgggacttacgtgttggtaactgttacgaaacgacgttgacgtctcgaccactaacttcgtttaacg

SEQ ID NO: 352133 - DNA, 567 bp, Homo sapiens
  misc_feature: GZ8MTXP01AWKCG.52.58.F03.1.454.CMB.2.raw
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
  modified_base (354)..(354): a, c, t, g, unknown or other
  misc_feature (354)..(354): n is a, c, g, or t
  modified_base (464)..(464): a, c, t, g, unknown or other
  misc_feature (464)..(464): n is a, c, g, or t
tcagcgcagtacgacacgaccggtgctcgatttagtctgatcgagaagggaaagggggagtcagtctcagtcaagacacagcatggacatgagggtccccgctcagctcctggggctcctgctactctggctccgaggtgccagatgtgacacccagatgacccagtctccatcctccctgtctgcatctgtaggagacagagtcaccatcacttggccgganaagtcagagcattgactaaatatttaaatgatcagacaagaaccgaggaacncccctagactcctgatctatgctcgccctactaagttgacaagtcgctccccatcggagttcgaggtcgggccggggtntcggtagggacaggtaccttacacttcactaaccataccgacgtccggttacttacgaaccgttagacgttacgttacgtaacttactacgtgggtcagacagtacgtanaactacctaccctcgtacgttaccgttccggcgtcggtaacttaggtggttacgtacgtacgaacgaacggttacgtgtcgtctacgaccttactcgttcgtc

SEQ ID NO: 352134 - DNA, 567 bp, Homo sapiens
  misc_feature: GZ8MTXP01BDBUD.52.58.F03.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (286)..(286): a, c, t, g, unknown or other
  misc_feature (286)..(286): n is a, c, g, or t
  modified_base (386)..(386): a, c, t, g, unknown or other
  misc_feature (386)..(386): n is a, c, g, or t
  modified_base (456)..(456): a, c, t, g, unknown or other
  misc_feature (456)..(456): n is a, c, g, or t
  modified_base (524)..(524): a, c, t, g, unknown or other
  misc_feature (524)..(524): n is a, c, g, or t
  modified_base (550)..(550): a, c, t, g, unknown or other
  misc_feature (550)..(550): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatccctccctgtctgcatctgtagganacagagtcaccatcacttggccgggnaagtcagagcagttggactaaaattatttaaatggtatcgagacaagaaaccgagggaaacncccctagacctctagatctatcgcttcgacccttctaatttgaactaaaggtcggccgtacccccaagttcggtaggtttccgagggtcgggccggggtntcgtagggacacggtacttcactctaccacatcaggtcgttactacgaactgaacgtacttgaactttanactggtcaggacaggtatcgtaacttaacctccccgtatacgtacctttcggccgtaaggacttacgngttggacttgaacgttaaacgcgtgngctgacttactcttgtc

SEQ ID NO: 352135 - DNA, 582 bp, Homo sapiens
  misc_feature: GZ8MTXP01A2BSR.52.58.F03.1.454.CMB.2.raw
  modified_base (223)..(223): a, c, t, g, unknown or other
  misc_feature (223)..(223): n is a, c, g, or t
  modified_base (495)..(495): a, c, t, g, unknown or other
  misc_feature (495)..(495): n is a, c, g, or t
  modified_base (575)..(575): a, c, t, g, unknown or other
  misc_feature (575)..(575): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatccctccctgtctgcatctgtaggagacagagtcaccatcacttgccgggnaagtcagagcattggactaaattatttaaattggtatcagacaaagaaaccgaggaaacgcccctagacctcctgatctatgctgccctactaatttgacaaggtcgcctccccagtcggaggttcaggtcggggccggggtaatcggtagggactacggtacctttcgactcctcaccatcgacgtcgttacttaccgaaccgttggacgtactttacggaactttactacgtgggtcaggtacaggtaatcgaaacttaccgttaccctntacgttacctttcccggcgtaacgggacttacggtagttcggtaagtcgttaacgaacgacgtggtcgctgccttacgtnttcgttc

SEQ ID NO: 352136 - DNA, 515 bp, Homo sapiens
  misc_feature: GZ8MTXP01EAUQF.52.58.F03.1.454.CMB.2.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (353)..(353): a, c, t, g, unknown or other
  misc_feature (353)..(353): n is a, c, g, or t
  modified_base (440)..(440): a, c, t, g, unknown or other
  misc_feature (440)..(440): n is a, c, g, or t
  modified_base (453)..(453): a, c, t, g, unknown or other
  misc_feature (453)..(453): n is a, c, g, or t
  modified_base (515)..(515): a, c, t, g, unknown or other
  misc_feature (515)..(515): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacaccagatgacccagtctccatccctccctgtctgcatctgtaggagacagagtcaccatcacttgccgggnaagtcagagctattggactaaattatttaaatggtatcagacaagaaaccgaggaaacncccctagactctgatctatgctgcctacaatttgactaaagtcgctccccatcgagttcaggtcggacgggntcgtagggacagtacttcactctacactatcgacgtcgttcttacaacgtgacgtacttagaacttactactggtacagctagagtnactacgtaccctntacgtcttccggcctggtacttagtagttgatcgacaacgactgtagctgcacttgttcgtn

SEQ ID NO: 352137 - DNA, 654 bp, Homo sapiens
  misc_feature: GZ8MTXP01B4798.52.58.F03.1.454.CMB.2.raw
  modified_base (284)..(284): a, c, t, g, unknown or other
  misc_feature (284)..(284): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcagttggactaaattatttaaattggtatacagacaagaaaccgagggaaacncccctaagacctcctagatactatgcctgacccttactaagtttgaactaaaggtcggaccgtacccccagttacggtaggtttaccgagggttcggggacccggggtaattcggtacggggaacctacggtaccttcgacctctaccaacctatcgacgtccggttacttaccgaaccgttggtaacggttactttacggaaactttacgtactcggggtacaggtacaggtacgtgtaacttaaccttaccccagtacgttaccgtttcccgggcccgtaagggtaacccttaggaggttcggaacttacggttaaccttaaacgggttacgtgggtcggtctcggaccttaccgtaattccgtttcg

SEQ ID NO: 352138 - DNA, 666 bp, Homo sapiens
  misc_feature: GZ8MTXP01BT019.52.58.F03.1.454.CMB.2.raw
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatccctccctgtctgcatctgtaggagacagagtcaccatcacttggccggganaagtcagagcattggactaaattatttaaatggtatcagacaagaaaccgagggaaacncccctagacctcctgatctangctgccctactaatttgactaaagtcggccgtacccccagtacggtaggttcgacgggtcggggacccggggtaatcggtggggaacctacggttacttaccgacttcctaccacctatccgacgtccggttacttaccgaaccgttgtaacgggttactttacggtaacctttacgtacgttcggggtactaggccgtaaggtagttacgtaacttaaccgttacccctacgtacggtaccgtttcccgggcccggttaagggtaaccttacgggtacggttaggtacgttacggttaaccgttaaacggttaccgttgggtacggtccttacggaccttaccgtaacgtttcgtttccg

SEQ ID NO: 352139 - DNA, 509 bp, Homo sapiens
  misc_feature: GZ8MTXP01A7RYQ.52.58.F03.1.454.CMB.2.raw
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
  modified_base (357)..(357): a, c, t, g, unknown or other
  misc_feature (357)..(357): n is a, c, g, or t
  modified_base (379)..(379): a, c, t, g, unknown or other
  misc_feature (379)..(379): n is a, c, g, or t
  modified_base (415)..(415): a, c, t, g, unknown or other
  misc_feature (415)..(415): n is a, c, g, or t
  modified_base (444)..(444): a, c, t, g, unknown or other
  misc_feature (444)..(444): n is a, c, g, or t
  modified_base (488)..(488): a, c, t, g, unknown or other
  misc_feature (488)..(488): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggnaagtcagagcattggactaaattatttaaatggatcaagcaagaaaccgaggaaacnccctagactcctgatctatgctcgccctctaatttgactaaagtcgctcccccagtcgaggttcaggtcgggccgggntcgtagggacagacttcactcncacatcagtcgtcttacactgagtacttgaaacttntactggtcagcagatgactaactaccctntacgtcttcggcctgggaccttagagttgatgttacgaattacnggtcgctcgcacctnttcgtn

SEQ ID NO: 352140 - DNA, 671 bp, Homo sapiens
  misc_feature: GZ8MTXP01COD5T.52.58.F03.1.454.CMB.2.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatccctcctgtctgcatctgtagganacagagtcaccatcacttgccgggacaagtcagagctagttggactaaattatttaaattggtatcagacaagaaaccgaagggaaacncccctagacctcctagatctatcgactcgacccttactaagtttgactaaaggtcggaccgtaccccccagttcggagtttcgaaggttcggggacccggggtaatcggtaggggactaacggtccttacgaacctctaccaccctagttcgagtccggttacttacgtaaccgtggtaacggtacgtttacggaaactttacgtacgtacggttacgagtaccgtaaggtagttacgtaaaccttaaccttaccccctagtaaccgttaccgttttccggccccgttaaggggtaaccttacggtaggttaggtaaacgtcgttaaaccgttaaaccgaagtttcggcggtcttacggaccttaccctaagttccgtttaaccg

SEQ ID NO: 352141 - DNA, 636 bp, Homo sapiens
  misc_feature: GZ8MTXP01B7RBN.52.58.F03.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtcaccatcacttggccggnaagtcagagctattggactaaattattaaattggtatcagacaagaaaccgaggaaacgcccctaagactcctgactctatgcctcgaccctttacctaagtttcgaaccgtaaaggtcggtacccgttaccccccaggttcggtaacgggtttccgaagggttccggggacccgggtaagtccgtacgggggactaacgtacctttacaccttcctaccaaccctatacgacgtccggttacttaccgaaccgtggtacgtactttacggaacttactacgttgggtacaaggccaagtacgtagtaaccttaactaccccgtgtaacgttccggttccgccgtaacgggacttacggtaggttagactagttaaccgaaaggttactgtggcctgacttcgtaattcgtttc

SEQ ID NO: 352142 - DNA, 586 bp, Homo sapiens
  misc_feature: GZ8MTXP01CVN2P.52.58.F03.1.454.CMB.2.raw
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (486)..(486): a, c, t, g, unknown or other
  misc_feature (486)..(486): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctcctgtctgcatctgtaggagacagagtcacatcacttgccggnaagtcagagcattggactaaattatttaaatgatcagacaagaaacgaggaaacnccctagacctctgatctancgctcgccttacaatttgacgtaaagtcggacctacccccctagtcggtaggttaccgagggtaccggggaccgggggtaatcggtacggggactacgtacctcactctaccactatcgagtccgttactacaccgtgagttacttacgacttatacnggtacngaccaggattagaacttaactaccccgtntacgtaccttccgggcctaagggaaccttagtaggttcgtaacgtcgttaaacgaaaccggttattcggaggtctcggacttaccctaagttcgttaacg

SEQ ID NO: 352143 - DNA, 748 bp, Homo sapiens
  misc_feature: GZ8MTXP01CEG1C.52.58.F03.1.454.CMB.2.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
tcagcgcagtacgacacgaccggtgctcgatttagtctgatcgagaagggaaagggggagtcagtctcagtcaggacacagcatggacatgagggtccccgctcagctcctgggctcctgctactctggctccgaggtgccagatgtgacacccagatcgacccagtcctccatccctccctgtctgcatctgtagganacagagtccacatcacgttcgccgggcaagtcagagctagtgactaaattatttaaagtgatcagacgaacgaaacgaggaaccncccctagacctacctagattctagtcgtactcgtacccttaccgtaatttcgaaccgtaaaggttccggtacccgttaccccccgtaaggttacggtacggggtttaccgaacgggggttccggggaccgggggttaagtccgggttaaggggaaccctaacggtaaccctttaccgaccttaccctacccaccgtaactacgtaacgggtccgtttacccttaaccgtaaaccggttaggtaacgggtttacctttaacggtaaacctttacgttaacgttacggtacgtaaacgtcgtaaagtacgttaacgtaaacctttaaccgttaccccctagtaaccggttacccgtttcccgggacccggtcgggaaacttaccggaggttacgggtaaactacgttaaaccgttaaacgttccgttaaggaccgtctacgaccttacctaacgttcgttaacccg

SEQ ID NO: 352144 - DNA, 520 bp, Homo sapiens
  misc_feature: GZ8MTXP01BQTWP.52.58.F03.1.454.CMB.2.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
  modified_base (353)..(353): a, c, t, g, unknown or other
  misc_feature (353)..(353): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtcaccatcacttgccggcaagtcagagcattggactaaatattaaattggatcagcaagaaaccagggaaacncccctagactcctgatctatgctgccctctaatttgacaaagtcgccgtccccatcgagttcaggtcgggccgggtntcgtgggacacgtacttcactctacaccatcagtcgtcttaccaactgacgtacttgaactttactactggtcagcagagtanactactaccctntacgtcttcggcctgggacttagcgttgatacgttacgaaacgttactggtcgctcgcacctaagttcttcg

SEQ ID NO: 352145 - DNA, 567 bp, Homo sapiens
  misc_feature: GZ8MTXP01DLG1F.52.58.F03.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (366)..(366): a, c, t, g, unknown or other
  misc_feature (366)..(366): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtcaccatcacttgccggnaagtcagagcattggacaaatatttaaattggtatcagcaagaaaccgaaggaaacgcccctagactcctgatctatgctgcccttacaatttgactaaagtcggaccgtcccccagtcgtaggttcgaggtcgggaccggggtntcgtaggggacagtaccttcactctcacatcagcgttctacacctgacgtacttagaacttactacgtgtacgagacagagtagaacttaactacccctgtaacgttccgttaccggcccgtaagggtacttagtacgttaggtactgttaaccgaaacgttaacgtggtaacgtcttacggaccactaacgttctttccg

SEQ ID NO: 352146 - DNA, 671 bp, Homo sapiens
  misc_feature: GZ8MTXP01AWC5H.52.58.F03.1.454.CMB.2.raw
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctggtaggagacagacgtcaaccatcacgttggccgganaagtcagtagctagttggactaaattatttaaatggtatacagacaaacgaaaccgaagggaaaccnccccctagacctccgtagattactatcgcttcgcccttactaagttttcgaacgtaaagtcggtacctaccccgtagtcggtaaggttccgaagggtcggggtacccggggaattccgtaggggaactacggtacctttacgaccttcctaccaacctagtaccgagtcccggttacttaccgaaccgttgggaacgttacgtttacgtaaacctttactacgtcggttacgacgactaagacgttacgaacttaacctacccccgtataaaccggttctttcccgggccgttaaggggtaaccttacggtaggttaccgtagtaccttaacggaaacgttacgtgggtgtaaccgcgaccttacttaagttcgtcg

SEQ ID NO: 352147 - DNA, 557 bp, Homo sapiens
  misc_feature: GZ8MTXP01A6HY2.52.58.F03.1.454.CMB.2.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (267)..(267): a, c, t, g, unknown or other
  misc_feature (267)..(267): n is a, c, g, or t
  modified_base (435)..(435): a, c, t, g, unknown or other
  misc_feature (435)..(435): n is a, c, g, or t
  modified_base (454)..(454): a, c, t, g, unknown or other
  misc_feature (454)..(454): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatccctccctgtctgcatctgtaggagacagagtcaccatcacttgccggnaagtcagancatgacaaatattaaatgatcagcagaacaggaacncccctagactctgatctatgctgcctctaattgacaaagtcgcgtccccatgagttcaggtcgggcccgggtaatcgagggacagtacttcactcctacaccgtatccagtccggtcttaccaaaccgtggtacgtacgtttacgaacttactacgtgggacagcagngtagactaactaccccgtntaacgtccgtttcgcccgttgggaaccttacgacgttggtaatacggttaacaaaacccggttacgtgcgggtcctacggaccgaccctaattcggttaaccg

SEQ ID NO: 352148 - DNA, 603 bp, Homo sapiens
  misc_feature: GZ8MTXP01CE3MV.52.58.F03.1.454.CMB.2.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (373)..(373): a, c, t, g, unknown or other
  misc_feature (373)..(373): n is a, c, g, or t
tcagcgcagtacgacacgaccggtgctcgatttagtctgatcgagaagggaaagggggagtcagtctcagtcaggacacagcatggacatgagggtccccgctcagctcctggggctcttgctactctggctccgaggtgccagatgtgacacccagatgacccagtcctccatccctccctgtctgcatctgtaggagacagagtcaccatccacgttcggccggganaagtcagagctagtgactaattattaatgatcagcaagaaccgaggaacncccctagacctctagatctatcgacttcgccctactaatttcgactaaaggtcgccgtaccccagtcggtaggttcgaggtcgggacccgggtntcggtagggactagtcctccgactcctcactacgtcgacgtccggttactaccgtacgtggtacgttacttaggaactttactacgtggtacagccgtagtagtacgtaactaccctacccgtgtaaccgttaccgttcccggccgttaaggtaacttagtacggttgtaacgtacgttaaccgttaacgttacgtcggcgtaacgtcgacccttactcgttccgttaac

SEQ ID NO: 352149 - DNA, 494 bp, Homo sapiens
  misc_feature: GZ8MTXP02I1BOM.52.58.F03.1.454.CMB.2.raw
  modified_base (274)..(274): a, c, t, g, unknown or other
  misc_feature (274)..(274): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattgacaaatattaaatggtatcagcaagaaaccagggaaancccctagactcctgatctatgctgcctcaatttgacaaagtgctccccatcgagttcagtggcggggntctgggacagacttcactcncacatcagcgtcttacaacctgagtacttggaacttactactgtcagcagagtagataactacctacagtacttcgtccgtcggacgtacacgtaggatagtacaacgaactaagtggcgtcacacactctc

SEQ ID NO: 352150 - DNA, 489 bp, Homo sapiens
  misc_feature: GZ8MTXP02JGLYU.52.58.F03.1.454.CMB.2.raw
  modified_base (343)..(343): a, c, t, g, unknown or other
  misc_feature (343)..(343): n is a, c, g, or t
  modified_base (430)..(430): a, c, t, g, unknown or other
  misc_feature (430)..(430): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatattaaatggtatcagcagaaaccaggaaagcccctagactcctgatctatgctgccctccaatttgcaaagtgcgtccccatcgagttcagtggccggggntctgggacagacttcactctcaccatcagcggtcttcaacctgaggactttggaactttacactgtcagcagatgataatacccctnacgtacttcgcctggactagagtgactacgtacaaacgatgtcgctcgcacctactctg

SEQ ID NO: 352151 - DNA, 507 bp, Homo sapiens
  misc_feature: GZ8MTXP02G9E0Y.52.58.F03.1.454.CMB.2.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
  modified_base (346)..(346): a, c, t, g, unknown or other
  misc_feature (346)..(346): n is a, c, g, or t
  modified_base (439)..(439): a, c, t, g, unknown or other
  misc_feature (439)..(439): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtcaccatcacttgccgggcaagtcagagcattggcaaatattaaattggtatcagcagaaaccaggaaacncccctagactcctgatctatgctgccctcctaatttgacaaagtggctccccatcgagttcagtggccgggntcgtgggacagacttcactctcacatcagcgtcttacacctgacgtactttaggaacttactactgtctagcaggagtgaataactacccttnacgtaactttcggcccttagggtactacgacgtgactcgtacaaacgtaactgtagctgcaccatctg

SEQ ID NO: 352152 - DNA, 533 bp, Homo sapiens
  misc_feature: GZ8MTXP02G2ZB1.52.58.F03.1.454.CMB.2.raw
  modified_base (273)..(273): a, c, t, g, unknown or other
  misc_feature (273)..(273): n is a, c, g, or t
  modified_base (346)..(346): a, c, t, g, unknown or other
  misc_feature (346)..(346): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggacaaatattaaatgtatcagcagaaaccaggaaacncccctagacctcctagatctatgctgccctcaatttgacaagtgccgtccccatcgtagtcaggtcggcgggntcgtagggactagacttcactctcacatcagtcgtcttacaaccgtgtacggtacttaggaaccttatactgtacagcagtagtagaactaactcccctagacgttacgtttccggcccgttagggaccttagacgtggtaatcgtaacaaacgtacgtggtcggactacgactaacctactcgtcg

SEQ ID NO: 352153 - DNA, 493 bp, Homo sapiens
  misc_feature: GZ8MTXP02JAKQP.52.58.F03.1.454.CMB.2.raw
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
  modified_base (427)..(427): a, c, t, g, unknown or other
  misc_feature (427)..(427): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatattaaatggtatcagcagaaaccagggaaancccctagactcctgatctatgctgccctccaatttgcaaagtgcgtccccatcgagttcagtggccgggntctgggacagacttcactctcacatcagcgtnttcaacctgaggtacttgaacttactactgtcagcagatgataactaccctnagtacctttcggaccctggactacgagtggatcgtacaacgtactgtcggactcgacaccatcttg

SEQ ID NO: 352154 - DNA, 561 bp, Homo sapiens
  misc_feature: GZ8MTXP02GITY4.52.58.F03.1.454.CMB.2.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
  modified_base (373)..(373): a, c, t, g, unknown or other
  misc_feature (373)..(373): n is a, c, g, or t
  modified_base (484)..(484): a, c, t, g, unknown or other
  misc_feature (484)..(484): n is a, c, g, or t
  modified_base (548)..(548): a, c, t, g, unknown or other
  misc_feature (548)..(548): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtcctccatcctccctgtctgcatctgtagganacagagtcaccatcacttgcccggganaagtcagagcattggactaaattatttaaatggtatcagcaagaaaccagggaacncccctagactcctgatctatgctgcctacctaatttgactaaagtcggacctccccctagtcggtaggtttcgaggttcggggaccggggtntcgtggggactagtaccttcacttctacacctatcagtcgtcttacaccgtggacgtacttaggaactttacgactggtacagcgtagtatacgtaactactacccccgtntacgtaccgtttccggcccgtagggtactacgagttaggactcgtacaaagactgtaggctacncaaccttctctcg

SEQ ID NO: 352155 - DNA, 486 bp, Homo sapiens
  misc_feature: GZ8MTXP02HCO3Z.52.58.F03.1.454.CMB.2.raw
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (341)..(341): a, c, t, g, unknown or other
  misc_feature (341)..(341): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
tcagcgcagtacgacacgaccggtgctcgatttagtctgatcgagaagggaaaggggagtcagtctcagtcaggacacagcatggacatgagggtccccgctcagctcctggggctcctgctactctggctccgaggtgccagatgtgacacccagatgacccagtctccatcctccctgtctgcatctgtaggagacagatcaccatcacttgccgggnaagtcagagcattggacaaatatttaaatggtatcagcagaaaccagggaancccctagactcctgatctatgctgccctcaatttgacaaagtggctccccatcgagttcagtggcgggntcgtgggacagacttcactctcacatcagcgtctacactgagtactttgaactttacacttgcagcagagtnatactccnacgtacttcgcgtacggactacgagtgactcgtaacaacgacgtgtcgcgtcgacactactctcg

SEQ ID NO: 352156 - DNA, 579 bp, Homo sapiens
  misc_feature: GZ8MTXP02HIWIY.52.58.F03.1.454.CMB.2.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (381)..(381): a, c, t, g, unknown or other
  misc_feature (381)..(381): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtcaccatcacttgcccggganaagtcagagctagtgactaaattattaattgtatacagacaacgaaaccgaaggaaccgcccctaagacctcctagtactctatcgctcgaccctactaatttacgacgtaaggtcgtaccgtacccctagtcgtacggttcgaggtcgggcgggtntcgtaggactagtactcactcacacatcgagtcgtctacacgtgtacgtacgttacgtacttactacttcgtactagcgaagtagtagtaactaacctacccgtactacgtaccgttccggaccgtacggactacgtacggtagtactacgtaactaaacgtacgtggtcgtacctacgacctacctacgttacgtcg

SEQ ID NO: 352157 - DNA, 552 bp, Homo sapiens
  misc_feature: GZ8MTXP02ITOPL.52.58.F03.1.454.CMB.2.raw
  modified_base (277)..(277): a, c, t, g, unknown or other
  misc_feature (277)..(277): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
  modified_base (448)..(448): a, c, t, g, unknown or other
  misc_feature (448)..(448): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggacaaattattaaattggtatcagcaagaaaccgaggaaancccctagactcctgatctatgctgccctacctaatttgactaaagtggcgtccccatcgagttcaggtcggccgggntcgtgggacagtaccttcactctcacancagcgtctacacctgacgtacttagaacttactacttgctagcagacgtgtaataactacccctanacgtaccgtttccggacccttgggaccttacgagtacgggacttacgtaaccgtaaacgaacgttggtacgggtccttacggacctaaccctagtttcctttcg

SEQ ID NO: 352158 - DNA, 566 bp, Homo sapiens
  misc_feature: GZ8MTXP02IM70D.52.58.F03.1.454.CMB.2.raw
  modified_base (196)..(196): a, c, t, g, unknown or other
  misc_feature (196)..(196): n is a, c, g, or t
tcagcgcagtacgacacgaccggtgctcgatttagtctgatcgagaagggaaagggggagtcagtctcagtcagaacacagcatggacatgagggtccccgctcagctcctggggctcctgctactctggctccgaggtgccagatgtgacacccagatgacccagtctccatcctcctgtctgcatctgtagganacagagtcaccatcacttgccgggcaagtcagagcattggacaaattatttaaatggtatcagcaagaaaccgagggaaacgccccctagacctcctgatctatgctcgccctactaatttgactaagtcggccgtaccccagtcgaggtttcgaggtcggggacccggggtgtcgtacggggaacgtacgtaccttacacttctacccaccatcgacggtcggttccttacaaccgtgacggtacttcggaacttactactgtacagtcagtacgtagaactaactcccctagacgtacgttcgcccgtaggactacgacggttagacttacgactaaacgactggtcggctcgactacctatcttacg

SEQ ID NO: 352159 - DNA, 529 bp, Homo sapiens
  misc_feature: GZ8MTXP02HO37G.52.58.F03.1.454.CMB.2.raw
  modified_base (221)..(221): a, c, t, g, unknown or other
  misc_feature (221)..(221): n is a, c, g, or t
  modified_base (278)..(278): a, c, t, g, unknown or other
  misc_feature (278)..(278): n is a, c, g, or t
  modified_base (346)..(346): a, c, t, g, unknown or other
  misc_feature (346)..(346): n is a, c, g, or t
  modified_base (441)..(441): a, c, t, g, unknown or other
  misc_feature (441)..(441): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctcctgtctgcatctgtaggagacagagtcaccatcacttgccgggnaagtcagagcattggacaaattatttaaatggtatcagacaagaaaccagggaaacncccctagacctctgatctatgctgcctacatttgacaaagtgctccccatcgagttcaggtggcgggntcgtgggacagacttcacttcacacatcagcgtcttacaactgaacggtactttaggaactttactacgtgtcagctagatgaataactaccctnaacgttccgtttacggcccttgggaacccttgaaggttggattacggaacaaacgtacgtggtcgactcgacctaacgtcttctttcg

SEQ ID NO: 352160 - DNA, 493 bp, Homo sapiens
  misc_feature: GZ8MTXP02HQKD8.52.58.F03.1.454.CMB.2.raw
  modified_base (271)..(271): a, c, t, g, unknown or other
  misc_feature (271)..(271): n is a, c, g, or t
  modified_base (337)..(337): a, c, t, g, unknown or other
  misc_feature (337)..(337): n is a, c, g, or t
  modified_base (426)..(426): a, c, t, g, unknown or other
  misc_feature (426)..(426): n is a, c, g, or t
  modified_base (476)..(476): a, c, t, g, unknown or other
  misc_feature (476)..(476): n is a, c, g, or t
tcagcgcagtacgacacgaccggtgctcgatttagtctgatcgagaagggaaaggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatattaaatggtatcagcagaaaccaggaaanccctagactcctgatctatgctgctcaatttgacaaagtgctccccatcgagttcagtcggcgggntcgtgggacagacttcgactctcaccatcagcgtcttacaacctgagtactttgaacttactactgtcagcagagtgataactaccctnacgtactttcggccctgggactacgagtgactacgtacaaacggacttgnggctcgcaccatcttcg

SEQ ID NO: 352161 - DNA, 513 bp, Homo sapiens
  misc_feature: GZ8MTXP02FR5TM.52.58.F03.1.454.CMB.2.raw
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagatcaccatcacttgccgggcaagtcagagcattggacaaatatttaaatgtatcancagaaaccaggaacncccctagactcctgatctatgctcgtcctctaatttgacaaagtcggcgtccccccatcgaggtttcaggtcggggaccggggtatcgtggggaacagtacttacactctcaccatcagtcggtcttacaacctgacgtactttagaacttactactntacagcagngtnactaactaccctnacgactttcgccctggactacagtagatcgtacaacgtatggtagctgacacatctcg

SEQ ID NO: 352162 - DNA, 525 bp, Homo sapiens
  misc_feature: GZ8MTXP02HWSXH.52.58.F03.1.454.CMB.2.raw
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (445)..(445): a, c, t, g, unknown or other
  misc_feature (445)..(445): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcacatcacttgccgggnaagtcagagcattggcaaatattaaattgtatcagcagaaaccaggaaancccctagactcctgatctatgctgcctaccaatttgacaaaagtggcgtacccccatccgaggttcaggtcgggcgggntcgtggggcagtactcatcncacatcngcgtctacaacctgacggtactttgaacttactacttgtcagcagtagtagaactaactaccccctanacgtaccttccggacccgtgggacttacgaaggttgacttcgtacgaaacgtaacgtgtggtctacggcaaccttctctg

SEQ ID NO: 352163 - DNA, 587 bp, Homo sapiens
  misc_feature: GZ8MTXP02H28AB.52.58.F03.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (227)..(228): a, c, t, g, unknown or other
  misc_feature (227)..(228): n is a, c, g, or t
  modified_base (246)..(247): a, c, t, g, unknown or other
  misc_feature (246)..(247): n is a, c, g, or t
  modified_base (278)..(278): a, c, t, g, unknown or other
  misc_feature (278)..(278): n is a, c, g, or t
tcagcgcagtacgacacgaccggtgctcgatttagtctgatcgagaagggaaaggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtcacatcacttgccggganagnagnnatgataatattaatgtannagacaagaacgaggaacacctagacctctanatctatcgctctcctactattagaacgtaaggtcgtacctaccccgtagtacggtacggttacgaggtcggggacgggtgtcggtaggacctacgtaccttacctacctacctaccgacctatccgtacgtccgtaccttacgaccgtacgtaacgtacgtttacgtaacttacttacgtagtacgtagagagtagtacgtaactaacctacctacgtacgttaccgttaccggaccgtacggtactacgtacgtagtactacgtaacgtaacgtacgtaagtcgtacgtacgtactactactacgtcg

SEQ ID NO: 352164 - DNA, 578 bp, Homo sapiens
  misc_feature: GZ8MTXP02IAIKY.52.58.F03.1.454.CMB.2.raw
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggacaaattattaaatggtatcagacaagaaaccgagggaaacgcccctaagacctcctgatctatgctgccctactaatttgactaaagtcggaccgtccccctagtccgtaggttcgaggttcggggcccggggtatcggtagggacctagtaccttcactcctaccaccatcagtccggtcttacaaccgtgaacgtactttagtaaacttactactgtactagcagagtagaactaactaccctactacgttaccgtttccggacccttcgggtacctacgaggtacggtactacgttaccgaaaacgtacgtggtacggctcgacctaccattcttcg

SEQ ID NO: 352165 - DNA, 553 bp, Homo sapiens
  misc_feature: GZ8MTXP02JI45A.52.58.F03.1.454.CMB.2.raw
  modified_base (282)..(282): a, c, t, g, unknown or other
  misc_feature (282)..(282): n is a, c, g, or t
  modified_base (480)..(480): a, c, t, g, unknown or other
  misc_feature (480)..(480): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttggccgggacaagtcagagcattggactaaattatttaaatggtatcagacaagaaaccgagggaacncccctagacctcctgatctatgctcgccctactaatttgactaaaggtcggaccgtcccccagtcgaggttcgaggtcgggccggggtatcgtacggggacagtaccttcacctctaccacctatcgacgtcggttactacaccgtgtacgtacttagactttacacttgtcagacagagtagaactacgtaccctanacgtaccgtttcgcccgtagggactacgagtgactcgaactaacgagtcgtacggctacgctactactcgttc

SEQ ID NO: 352166 - DNA, 699 bp, Homo sapiens
  misc_feature: GZ8MTXP02JY6EO.52.58.F03.1.454.CMB.2.raw
  modified_base (283)..(283): a, c, t, g, unknown or other
  misc_feature (283)..(283): n is a, c, g, or t
tcagcgcagtacgacacgaccggtgctcgatttagtctgatcgagaagggaaagggggagtcagtctcagtcaggacacagcatggacatgagggtcccccgctcagctcctggggctcctgctactctggctccgaggtgccagatgtgacacccagatgacccagtctccatcctccctgtctgcatctgtaggagacagagtcaccatcacttggccgggcaagtcagagctattggactaaattatttaaagtgtatcagcaagaaaccgagggaaacncccctagactctgatctatgctcgccctactaatttcgactaaaggtcggtacctcccccgagttccggtaggtttaccgaggggttcggggacccggggtagtccgggttacgggggaacctaggtaacccttttacccgaaaccctttcccgtaaacccgaccctaaacgttcccgtaaacggttcccgggtttaacccttttacccgaaacccgttagggtaacggttacgtttacggaaacttttaccgtaacgttcggtacaacgtacgtaagggtagtaacgaacttaaaccctaccccgttacgaacgttacccgtttccgggaaccccgttagggtaacctacgaggtacggtatacgtaaaccgtaaacgtacgtggtacggtactcgaacctcgtactcgtttacg

SEQ ID NO: 352167 - DNA, 502 bp, Homo sapiens
  misc_feature: GZ8MTXP02HXKP2.52.58.F03.1.454.CMB.2.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (489)..(489): a, c, t, g, unknown or other
  misc_feature (489)..(489): n is a, c, g, or t
  modified_base (502)..(502): a, c, t, g, unknown or other
  misc_feature (502)..(502): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctcctgtctgcatctgtagganacagagtcaccatcacttgccggnaagtcagagcattgcaaatattaaatgtatcagcagaaccaggaaagcccctagactcctgatctatgctgcctcaaatttgactaaagtggctccccatcgagttcagtggcgggntcgngggacngacttcactctcaccatcagcggtctttacaaccttgagtacctttggaacttactactgtcagcagagtanaataactaccctanacgtaccgttcgccgtacggtactacgagtgactacgaacaaacgacgtgtcgacncgacactcttctn

SEQ ID NO: 352168 - DNA, 539 bp, Homo sapiens
  misc_feature: GZ8MTXP02FPJKV.52.58.F03.1.454.CMB.2.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctcaatcctccctgtctgcatctgtagganacagagtcaccatcacttgccgggcaagtcagagcattggacaaattattaaattggtatcagcaagaaaccagggaacncccctagactctgatctatgctgcctacaatttgacaaagtcgcctccccatcgagttcaggtcggccggggatcgtggacagtaccttcactctacacatcgagcgttcttacaacctgacgtacttaggaacttacgtactgtactagactaggtatagaactaactaccccgtatacgtaccgtttcggcccttagggtacctacgacgtagactacgtaacaaacgtaactggtacgtctacgacctacctatcttcg

SEQ ID NO: 352169 - DNA, 554 bp, Homo sapiens
  misc_feature: GZ8MTXP02JK0WJ.52.58.F03.1.454.CMB.2.raw
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatattaaatggtatcagcagaaaccagggaaancccctagactcctgatctatgctgcctcaatttgcaaaagtggctccccatcgagttcagtggccggggntcgnggacagctcactctacaacatcagtcttctacaactgaacggtactttagaaactttactacgtgtacgtagacgagaagtagtaactaaaccttaaccctacctacgtaccgttaccgtaccgtaccggtacgtaacgtacgtaggtacgtacgtaacgtaaaacgtaaacgtaacgtacggtacgtacgtacacctaactactcg

SEQ ID NO: 352170 - DNA, 716 bp, Homo sapiens
  misc_feature: GZ8MTXP02FMQP4.52.58.F03.1.454.CMB.2.raw
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggnaagtcagagcattggactaaattatttaaattggtaatcagcagaaaccagggaaacnccccagactcctgatctatgctgccctaccaatttcgactaaaggtcggaccgtcccccaagtcggtaaggtttcgagggttcggggaccggggtagtcggtagggggacctacggacctttacaccttaccttaccaaccctaattaccgaacggtcccggtttaccttaccgtaaacccgtggtaaacgggtaacgttttacggggtaaaaccttttaccgttaaaccggttcgttaacccgaaggtaccgtaaagggtaacggtaacgtaaattaaaacccggttacccccttaacggtaacgttaacccgtttcccgggaccccgttacgggggtaacccttaacggtaacggttacgggtaacgttacggtaaccctaaaaaggtaaccgttgtaacgggtcttacgggacctaacccgtatacgtttccg

SEQ ID NO: 352171 - DNA, 637 bp, Homo sapiens
  misc_feature: GZ8MTXP02GLBWF.52.58.F03.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (282)..(282): a, c, t, g, unknown or other
  misc_feature (282)..(282): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatccctccctgtctgcatctggtagganacagagtcaccatcacttgccgggnaagtcagagctattggacaaattatttaaatggtatcagacaagaaaccgaggaaacncccctagactcctgatctatgctcgcctactaatttgactaaaggtcggacctaccccagtcgtaggttacagggttcggggccggggtatcgtaggggactagtaccttcgaccttctaccaacctatccgaggtccggttactttaccaaccgttggtaacggttaacgtttacggaaactttactacgtagtactaggactaaggtagtacgtaaattaacccgttaccccacgtacgttacccgtttacccgggcccgttacggggtaaccttacggtaggtacggtaaactcgtaaaaccgaaaacggtacgttggtacgggtcttacggacctacctacttctttaccg

SEQ ID NO: 352172 - DNA, 531 bp, Homo sapiens
  misc_feature: GZ8MTXP02GMEFU.52.58.F03.1.454.CMB.2.raw
  modified_base (225)..(225): a, c, t, g, unknown or other
  misc_feature (225)..(225): n is a, c, g, or t
  modified_base (282)..(282): a, c, t, g, unknown or other
  misc_feature (282)..(282): n is a, c, g, or t
  modified_base (365)..(365): a, c, t, g, unknown or other
  misc_feature (365)..(365): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatccctccctgtctgcatctgtaggagacagagtcaccatcacttggccggganaagtcagagcattggacaaattatttaaatggtatcagacaagaaaccagggaaacncccctagactctgatctatgctcgccctactaatttgactaaaggtcggccgtccccagtcgaggttcaggtcggccggggtntcgtgggacagtcttcactctcacatcagcgtcttacacctgagtacttaggaactttactactgtacagctagagtagataactaccctagacgttacgtttccggacctagggtactacgagtaggactcgtaacaacgtatgtcggactcgacactactctcg

SEQ ID NO: 352173 - DNA, 662 bp, Homo sapiens
  misc_feature: GZ8MTXP02H5F4O.52.58.F03.1.454.CMB.2.raw
  modified_base (220)..(220): a, c, t, g, unknown or other
  misc_feature (220)..(220): n is a, c, g, or t
tcagcgcagtacgacacgaccggtgctcgatttagtctgatcgagaagggaaaggggagtcagtctcagtcaggacacagcatggacatgagggtccccgctcagctcctggggctcctgctactctggctccgaggtgccagatgtgacacccagatgacccagtctccatcctccctgtctgcatctgtagagacagagtcaccatcacttgccgggnaagtcagagcattggacaaatattaatgtatcagcagaaacgaggaacgcccctagactcctgatctatgctcgcctacctaatttgaactaaaggtcggaccgtcccccctaagttccggtaaggttccgtaaggttcggggacccggggtattcccgggttaggggaacctacggtaacctttccaacttccctacccaccaacgtccgtaacgggtccggttacctttaccgaaacccgttggtaacggtaaccttttgggaaaacctttacgttacgttgtacctagacgtaaggtaacgttagtaaactaacttaacccctattaaccgtacgtttcccggacccggtttagggacccttaacgaggtacggtacttacgaccgtaaaaccgtaacgttggttaacggcttacgaccaacccgtttacttaccgtcg

SEQ ID NO: 352174 - DNA, 521 bp, Homo sapiens
  misc_feature: GZ8MTXP02HUGO8.52.58.F03.1.454.CMB.2.raw
  modified_base (221)..(221): a, c, t, g, unknown or other
  misc_feature (221)..(221): n is a, c, g, or t
  modified_base (275)..(275): a, c, t, g, unknown or other
  misc_feature (275)..(275): n is a, c, g, or t
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcacatcacttgccgggnaagtcagagcattggacaaattatttaaatggtatcagcaagaaacaggaaacncccctaagactcctgatctatgctgcctacaatttgactaagtcggcctaccccattcgagttcgaggtcgggcgggntcgtaggacagtactcactcncacatcagtcgtcttacaaccgtgtacgtactttagaacttactactgtactagcagagtanaactaactcccctanacgtacttcgaccttagggaccttagagtggactcgtaaccaagactggtagctcgactacctattctac

SEQ ID NO: 352175 - DNA, 550 bp, Homo sapiens
  misc_feature: GZ8MTXP02ICB38.52.58.F03.1.454.CMB.2.raw
  modified_base (197)..(197): a, c, t, g, unknown or other
  misc_feature (197)..(197): n is a, c, g, or t
  modified_base (458)..(458): a, c, t, g, unknown or other
  misc_feature (458)..(458): n is a, c, g, or t
  modified_base (474)..(474): a, c, t, g, unknown or other
  misc_feature (474)..(474): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtcaccatcacttggccggcaagtcagagcattggacaaattatttaaatggtatcagcaagaaaccgagggaacgccccctagacctcctagatctaatgactcgacctctaatttgacaaagtcggcgtacccccatccgagttaccgagtcgggccggggtatcgtaggggaactagtacttcactcctacacacttcagcgttactcaacctgacgtacttagaacttactacttcgtacagacagtagtanaacttaactcccctanacgtactttcggccctagggaccttagagtacggatacgtacgaaacgtatcggtagcctggaccactactacttc

SEQ ID NO: 352176 - DNA, 580 bp, Homo sapiens
  misc_feature: GZ8MTXP02I1O96.52.58.F03.1.454.CMB.2.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
  modified_base (372)..(372): a, c, t, g, unknown or other
  misc_feature (372)..(372): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtcaccatcacttcggccgggnaagtcagagcattggacaaattatttaaattggtatcagcaagaaaccgaggaaacncccctagactcctgatctatgctcgccctactaatttcgactaaagtcggtccgtacccctagtcgtaggttcagggttcgggccggggtnttcgtaggggacagtaccttcgactctaccacactcaggtcgtctacaaccgtgagtacttagtacttactacttgacagcagtagtagtaactaactccctacgtacgttaccgtttcggaccccgtagggtaccttacgacggtagacgttacgtaaccgtaaacgtacgtaaggtcgcttacggcctaaccgttacttacgttcg

SEQ ID NO: 352177 - DNA, 590 bp, Homo sapiens
  misc_feature: GZ8MTXP02HSD7I.52.58.F03.1.454.CMB.2.raw
  modified_base (197)..(197): a, c, t, g, unknown or other
  misc_feature (197)..(197): n is a, c, g, or t
  modified_base (367)..(367): a, c, t, g, unknown or other
  misc_feature (367)..(367): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtcaccatcacttggccgggacaagtcagagcattggactaaattatttaaatggtatcagacaagaaaccgagggaaacgcccctagactcctagatctatgctcgcctctaatttgactaaagtcggcctaccccagtcgtaggttcaggtcggggcggggtntcggtagggacacgtacttcactctcaccatcaggtcgttcttacaaccgtgacggtacttaggaactttactacgtgtacgagtcagacgtagaactaacctaccctactaacgtaccgtttccggacccgttagggaaccttggaacgttgggtacttacgtaacgtaaaccgtagtaaggtacgtacctttacgaaccttacgttccgtttacgtttccc

SEQ ID NO: 352178 - DNA, 763 bp, Homo sapiens
  misc_feature: GZ8MTXP02GOL8I.52.58.F03.1.454.CMB.2.raw
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagagacagagtcaccatcacttgccgggcaagtcagncattggactaaatattaaatgtatcagnaacgaaaccagggaacncccctagacctcctgatctatcgactcgacccttactaaagttttcgaacgtaaggtccggtacctacccccccgtagtacccggtaggttaccgtaggggtcggggtacccgggggtattcccgggtagggggaaaccctacgggttacccttccgtaaaccgttcccttaccgaaccctacttaccgtaaccgggtcccggtttaccctttacccgtaaccgttacgggtaaccggtttaacgttttaccgggtaaacctttttaaccgtaacccgttggttacccgaaggtaccgtaaccgggtaaggttacgttaaaacccgttaaacccgttaaccccctacgttaaaccggtttacccgttttccggggaccccgtttacggggtaacctaccggtaaggttcgtaacgttacgttaaaccgaaaacgttacggtcggtacggttaaccttcggtaacccgtttcgttaccgttacgtttccg

SEQ ID NO: 352179 - DNA, 557 bp, Homo sapiens
  misc_feature: GZ8MTXP02I9HNV.52.58.F03.1.454.CMB.2.raw
  modified_base (288)..(288): a, c, t, g, unknown or other
  misc_feature (288)..(288): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (463)..(463): a, c, t, g, unknown or other
  misc_feature (463)..(463): n is a, c, g, or t
  modified_base (506)..(506): a, c, t, g, unknown or other
  misc_feature (506)..(506): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatccctccctgtctgcatctgtaggagacagagtcaccatcacttgccggacaagtcagagctagttggactaaattatttaaagtggtaatcagacaaagaaaccgagggaaaccncccctaagacctcctagatctatgctcgtccctacgtaattcgacgtaaagtcggactcccctagtcgagttcgaggtcggcgggtntcgngggactcgacttcactctaccactatcgagtcggtctacaacgtgacgttacttacgaacttctagtgtacagtacagacgtanaactacgtaccctagaccgttacttcggccgttaggactacgngtagtactacggtaacaacgtacgtgtacgctacgactacgtcttacgttc

SEQ ID NO: 352180 - DNA, 533 bp, Homo sapiens
  misc_feature: GZ8MTXP02JBSAR.52.58.F03.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (350)..(350): a, c, t, g, unknown or other
  misc_feature (350)..(350): n is a, c, g, or t
  modified_base (440)..(440): a, c, t, g, unknown or other
  misc_feature (440)..(440): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtcaccatcacttgccggnaagtcagagcattggacaaatattaaatgtatcagacaagaaaccagggaaacgcccctagactcctgatctatgctgcctcaatttcgacaaagtcggctccccatcgagttcaggtcgggccgggtntcgtggggactagacttcactctacacatcagcgtctacactgagacttagaacttactactgtacagacagatagataactacccctanacgtactttcccggccgttacgggtactacgaggtacgactcgtaaaccgaaacgtaacgtggtcgacgttcgacctaccgtactcgtttacg

SEQ ID NO: 352181 - DNA, 648 bp, Homo sapiens
  misc_feature: GZ8MTXP02HEHU3.52.58.F03.1.454.CMB.2.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (289)..(289): a, c, t, g, unknown or other
  misc_feature (289)..(289): n is a, c, g, or t
tcagcgcagtacgacacgaccggtgctcgatttagtctgatcgagaagggaaagggggagtcagtctcagtcaggacacagcatggacatgagggtccccgctcagctccgtggggctcctgctactctggctccgaggtgccagatgtgacacccagatcgacccagtctccatccctcctgtctgcatctggtagganacagacgtccaccatcacttggccggganaagtcagagctagttggactaaattattaaattggtatcagacaagaaaccgaggaaacncccctaagacctcctagatctatgctcgccctacctaatttcgactaaaggtcggaccgtaccccagtcgtaggttccgaggtcgggccggggtatcggtaggggactagtacttcactcgtaccacgtactcgacggtccggttacttaccgtaccgtaggtacggttaaccgtttacggtaaaccttttacgtacgttacgtacgtacgtacgaagtacgttagaacttaaccgtacccctacgtacgttaccgtttaccggacccgttaggggtaaccctaggtaacggttggtaaacgttacgtaaacgtaaacggtaacgtggtacgtacgtacgactactactttacgttccg

SEQ ID NO: 352182 - DNA, 583 bp, Homo sapiens
  misc_feature: GZ8MTXP02F83C9.52.58.F03.1.454.CMB.2.raw
  modified_base (286)..(286): a, c, t, g, unknown or other
  misc_feature (286)..(286): n is a, c, g, or t
  modified_base (383)..(383): a, c, t, g, unknown or other
  misc_feature (383)..(383): n is a, c, g, or t
  modified_base (561)..(561): a, c, t, g, unknown or other
  misc_feature (561)..(561): n is a, c, g, or t
  modified_base (579)..(579): a, c, t, g, unknown or other
  misc_feature (579)..(579): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcacatcacttggccgggcaagtcagagctattggactaaattaatttaaagttggtatacagacaagaaaccgagggaaacncccctagacctcctgactctatgtctgtccctactaatttcgaacgtaaggtcggcctaccccgtagtccggtaggttcgaggtcggggccggggtntcggacgggtacgtacgtacttcactctaccgactagtcgacggtcgtcttacgaccgttgtaacgttacgtttagaactttactacgtgtactagcaaggtagagtaacttactacccctatacgtacgttcccgaccgtggtacctacgtagtcggtactcgtaaacaacggtacnggtcgactcgactacctntctc

SEQ ID NO: 352183 - DNA, 594 bp, Homo sapiens
  misc_feature: GZ8MTXP02JFPDW.52.58.F03.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (476)..(476): a, c, t, g, unknown or other
  misc_feature (476)..(476): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctggtagganacagagtcaccatcacttggccgggnaagtcagagcagttggactaaattatttaaatggtatcagcaagaaaccgaggaacncccctagacctctgatctatgctgcctacattgactaagtcgctaccccatcgaggtcaggtggcgggntcgngggacagtacttcactctacactactgacgtcgttaccttacaaccgtggtacggtactttaggaaactttactacgttagtcgaagacgtaggtaactacgtaactaaacctaccccgtanaaccggttacgtttcccggggacccttaggggtactaaccgtacggggttaggtaaacttacggtaaccgtaaaacgtacgtggtacggcctacggaacctaccgtattccgtttacg

SEQ ID NO: 352184 - DNA, 699 bp, Homo sapiens
  misc_feature: GZ8MTXP02IN98B.52.58.F03.1.454.CMB.2.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
tcagcgcagtacgacacgaccggtgctcgatttagtctgatcgagaagggaaagggggagtcagtctcagtcaggacacagcatggacatggacgggtccccgctcagctccgtggggctcctgctactctggctccgaggtgccagatgtgaccaccagatgacccagtcctccatccctccctgtctgcatctggtagganacagacgtccaccatcacgttggccgggacaagtcagagctagtgataattatttaaatggtatcagacaacgaaaccgaggaaacctcccctagactcctagatctatgacctgccctataagtttcgactaaaggtcggaccgtacccctagtcgtacggtccgtaggttcggggaccggggtntccggtaggggtaacctacgtaaccttcacctttacccaccaacccgtagtccgacgggtaccggttactttacccaaacggttcggttaaaggttaccgttttacggtaacctttaccgttaactcggttaccaagtactaagggtaacgttacgtaaactaaccttaccccgtataccgggttaaccgtttccgggacccgttaggggaaccttaggacggttacggtaacgttaaccggttaaccgaaaacgggttacgttgggaacccggtacttccggaacctaccgttaactttacctttacgg

SEQ ID NO: 352185 - DNA, 539 bp, Homo sapiens
  misc_feature: GZ8MTXP02G038V.52.58.F03.1.454.CMB.2.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (440)..(440): a, c, t, g, unknown or other
  misc_feature (440)..(440): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaagtgccagatgtgacacccagatgacccagtctcatcctcctgtctgcatctgtaagganacagagtcacatcacttgccgggcaagtcagagctagtggacaaatattaaattggtaatcagacaagaaaccaagggaaacncccctagactctagatctatgctgccctactaatttgacaaaagtcggcgtccccagtccgaagttcaaggtggccgggatcggtaggacagacttcactctacaccatcagcgtcttacaacctgagtaccttaggaacttactactgtcagcagagtanataactaccctcgaacgtacgtttcgacccgtaggacctaaatggacggttaactacgtaaacgaaacgtagtgtcgactacgacctactacttactcg

SEQ ID NO: 352186 - DNA, 602 bp, Homo sapiens
  misc_feature: GZ8MTXP02HJL50.52.58.F03.1.454.CMB.2.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtagganacagagtccaccatcacttcgccgggcaagtcagagcattggactaaattatttaaatggtatcagacaagaaaccgaagggaacncccctagacctcctagatctagtcgctcgtacctacctaagtttcgacgtaaaggtcggaccgtaccccctaagtcgtacggttcgacgggtcgggaccggggtatcggtagggactacgtaccttcgacttcaccacatcgagtcggttactactaccgtggtacgtactttacggaactttacgtacgttgtacgtagtcgaaaggtactacgtaactaaccttacccgtactacgttaccgtttccgaccggttacggacctagtacggtgtactacgactaacgtacgtgtcgacgttcgactactcttcgtacg

SEQ ID NO: 352187 - DNA, 568 bp, Homo sapiens
  misc_feature: GZ8MTXP02GQ0H2.52.58.F03.1.454.CMB.2.raw
  modified_base (198)..(198): a, c, t, g, unknown or other
  misc_feature (198)..(198): n is a, c, g, or t
  modified_base (383)..(383): a, c, t, g, unknown or other
  misc_feature (383)..(383): n is a, c, g, or t
  modified_base (409)..(409): a, c, t, g, unknown or other
  misc_feature (409)..(409): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatccctccctgtctgcatctgtagganacagacgtcaccatcacttggaccgggacaagtcagagctattggactaaattaatttaaattggtatacagacaacgaaaccgaggaaaccgcccctagaacctcctagactctatgctcgtcccttactaatttgactaaggtcggacctccccctagtcgtaggtcgaggtcgggaccgggntcgtgggacagtactcactcacaccntcgagtcgtctacactgagtacttagacttagtactgtangacagtagtacaattacccacctanacgtaccgtttccgaccgttcggaaccctaggtacgtcggaaactacgtacgaaaacgttctggtcgactcggtaccactttacgtcctttacg

SEQ ID NO: 352188 - DNA, 609 bp, Homo sapiens
  misc_feature: GZ8MTXP02JK0IS.52.58.F03.1.454.CMB.2.raw
  modified_base (282)..(282): a, c, t, g, unknown or other
  misc_feature (282)..(282): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttggccgggacaagtcagagctagttggactaaattatttaaatggtatcagcaagaaaccagggaacncccctagactcctgatctatcgctcgccctactaatttcgactaaagtcggccttaccccagtcgaggttcaggtcggccgggtatcgtgggacagtacttcactctaccactatcgagtccgttactaccaaccgtggtaacgttactttaggaaacctttacgtacgtgtactagacgtaagtagtacgtaacttaaccgtacccctagtaccgttaccgtttcccggacccgttacggggtaactaccggtacggtaggtacgtacgtaaaccgtaaaccggtaagttcggtaacggcgttacggccctaacgttactctttcg

SEQ ID NO: 352189 - DNA, 753 bp, Homo sapiens
  misc_feature: GZ8MTXP02JM56I.52.58.F03.1.454.CMB.2.raw
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgaccacccagatcgacccagtctccatccctccctgtctgcatctgtaggagacagagtccaccatcacgttcggcccggacaagtcagagctagttggaactaaattatttaaagtggtatcagacaagaaacgaggaacacccctagacctctagactctatcgtctcgtacccttacctaagtttcgaacgtaaaggtcggtacctaccccgtagttaccgggtacgttcggagggtccggggaccggggtattccgggaaggggtacctaaccgtcctttaccaccgttacctacccaactacgtacgacggttccgttaccgttaaccgaccgtaggtaacgtttacgttacgtaaacctttacgacgttacgtaccgacgtacgtaaacgggtaacgttaccgtaaaacttaaacccccgttaccccgtaacggttaacccggtttaccccgggtttacccgggacccccggtttaaggggtaacccttaacgggtaacgggttaacgggtaactttaaccgggggtaaaaccctaaaacggtacgttcggggttaccggaccttacggaaccctttacctaacgtttaccggtttccg

SEQ ID NO: 352190 - DNA, 607 bp, Homo sapiens
  misc_feature: GZ8MTXP02FIC9P.52.58.F03.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (276)..(276): a, c, t, g, unknown or other
  misc_feature (276)..(276): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatccctcctgtctgcatctgtagganacagagtcaccatcacttgccggnaagtcagagcatggacaaattattaaattggtatcagacaagaaaccagggaacnccctagacctcctgatctatgctcgccctacctaatttcgacaaaggtcggcgtacccccagtcggaggtttcgaggtcggggcggggtatcggtgggaactagtacttcactctaccacctatcagcgtacttacaccgtgacgttacttaggaacttactactgtacagtcaaggtagtagaacttaaccttacccctagaacgtacccgtttcgggaccccgttaggggaaccttacggtacggttaggaacgttacggtaaaccgaaaacggttaacgtcgggttacgggtaccttacggaccctaaccgttacggttcctttacgg

SEQ ID NO: 352191 - DNA, 668 bp, Homo sapiens
  misc_feature: GZ8MTXP02GOYMB.52.58.F03.1.454.CMB.2.raw
  modified_base (223)..(223): a, c, t, g, unknown or other
  misc_feature (223)..(223): n is a, c, g, or t
  modified_base (285)..(285): a, c, t, g, unknown or other
  misc_feature (285)..(285): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttggccgggnaagtcagagctagttggactaaattaatttaaattggtatcagacaagaaaccgagggaacncccctagacctctagactctatcgctcgccctacctaatttgaacgtaaaggtcggtcctacccccgagttccggtaggtttcgaacgggttcggggacggggagttcggtacggggaaccacggttaccttcaccttccgtaccaaccgtataccgaacggtccggttaccttaccgaaccggtaggtaacggttacgtttacggaaaccgtttacgttaccgtagttaccgagtaccgtaaggtacgtaacgtaaacttaacccgttacccctactacgttacccgtttacgggaccccgttagggtacctacggtaggttacgtacgtacgtaaacgaaacgtacgtcggtcggtactacgactaacctgtacgtttccg

SEQ ID NO: 352192 - DNA, 580 bp, Homo sapiens
  misc_feature: GZ8MTXP02GAJF0.52.58.F03.1.454.CMB.2.raw
  modified_base (281)..(281): a, c, t, g, unknown or other
  misc_feature (281)..(281): n is a, c, g, or t
tcagcgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctcctgtctgcatctgtaggagacagatcaccatcacttgccgggcaagtcagagcatgcaaatattaaatggtatcagcagaaaccaggaaagcccctagactctnatctatgctgcctcaatttgacaaagtggctaccccatcgagttcagtggccggggatcgtgggacagacttcactctcacagtcacgcggttctacaacctgacggtactttaggaacttactacgtgtacagcgaagagttagaacttaaactaccccctgtaacgtacttttccgggacccccttaggggtacccttaaacgtacggggttacggtaaagttcggttaaaccgaaaaacggttaaaccgtaagggttagggccttaaggaccgaacccgtaatccgttttaaccgg

SEQ ID NO: 352193 - DNA, 493 bp, Homo sapiens
  misc_feature: GZ8MTXP01AUIMP.52.38.D05.1.454.CMB.2.raw
  modified_base (232)..(232): a, c, t, g, unknown or other
  misc_feature (232)..(232): n is a, c, g, or t
  modified_base (273)..(273): a, c, t, g, unknown or other
  misc_feature (273)..(273): n is a, c, g, or t
  modified_base (351)..(351): a, c, t, g, unknown or other
  misc_feature (351)..(351): n is a, c, g, or t
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
tcagcgcagtacgacacgaccggtgctcgatttagtatctgatagttgggtttgggggtccaggaggcagaactctgggtgtctcaccatggcctggatccctctcttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagaagcggcaggccctgtgtggngatgtataaagcactgagaggccctcgagggatccctgagcgattcgtcctagggctccagtcgaagggacaacggtnacagttcggccatcagtggagtccaggcagnggacgagcgtgatatatntnagtacaananacacactgtactatgtntcgtactgcacgagtcgaccgtcgtcggttcgcgccaacggccaacccaccncnctcttcgtcg

SEQ ID NO: 352194 - DNA, 510 bp, Homo sapiens
  misc_feature: GZ8MTXP01D5PYX.52.38.D05.1.454.CMB.2.raw
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
tcagcgcagtacgacacgaccggtgctcgatttagtatctgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggcaggccctgtgtggtgatgtataaagacactgaagaggccctcgagggactcccgtgagcgattcctctggctccgaggtcagggcaaacggtcacatggcatcagtgatcagcagaggacgagctgactattatgtacaatcaaacagacaccattggtacttatgtcttcggaactgcgactaaacgggttcaacccgtccgagggttcacggcccaaggccaaaccccncttcgtcncgtc

SEQ ID NO: 352195 - DNA, 482 bp, Homo sapiens
  misc_feature: GZ8MTXP01EJPSJ.52.38.D05.1.454.CMB.2.raw
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (395)..(395): a, c, t, g, unknown or other
  misc_feature (395)..(395): n is a, c, g, or t
  modified_base (450)..(450): a, c, t, g, unknown or other
  misc_feature (450)..(450): n is a, c, g, or t
tcagcgcagtacgacacgaccggtgctcgatttagtatctgatagttgggtttgggggtccaggaggcagaactctgggtgtctcaccatggcctggatccctctcttctcccctcctcactctctgcacaggctctgaggcctcctatgagctgacacagccacctcggtgtcagtgtccccaggacagacggccaggatcacctgctctggagatgcattgccaaacgntatgcttatggtacagcagagcggcaggccctgtgtggngatgtataaagacactgagaggcctnagggatcctgagcgattctctggctcaggtcaagggacaacggtcacattgccatcagtgatcagcagagacgaggctgactatattagtcaagtcaanagacacctatggtacttatgtctacggactgcgacaaggtcaccgtctgggttcngcccaaggccaacccactgcaacgttctcccg

SEQ ID NO: 352196 - DNA, 533 bp, Homo sapiens
  misc_feature: GZ8MTXP01B26PQ.52.38.D05.1.454.CMB.2.raw
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (429)..(429): a, c, t, g, unknown or other
  misc_feature (429)..(429): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgctatggtacngcagagcggcagccctgtgtgtgatgtataaagcactgagacggccctcgagggatccctgagcgattccctctggctcccgaggtacgaagggaacaaacgggtcaactagttgggaccatacgagttggacgtccgaggcaggaggacgagctgatattattgtacaattcaaanacgacactattaggtacttatcgtcttacggaactgacgttacaaggttcaccgtcttgggttcacggcccaaggcccaaacccgcttacgtccttaacgttcc

SEQ ID NO: 352197 - DNA, 522 bp, Homo sapiens
  misc_feature: GZ8MTXP01BR7VC.52.38.D05.1.454.CMB.2.raw
  modified_base (287)..(287): a, c, t, g, unknown or other
  misc_feature (287)..(287): n is a, c, g, or t
  modified_base (371)..(371): a, c, t, g, unknown or other
  misc_feature (371)..(371): n is a, c, g, or t
  modified_base (485)..(485): a, c, t, g, unknown or other
  misc_feature (485)..(485): n is a, c, g, or t
tcagcgcagtacgacacgaccggtgctcgatttagtatctgatagttgggtttgggggctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattcgaccaaacgatatgcttatggtaccagcagaagccggcaggcccctgtgttggngatgtaataaagacactgagacggccctcgagggactcccgtgacgccgattctctggctaccgaggtcgagggacacggtcanattggcatcgagtggagtccaggacaggaggacgaggctgactagttattgtacaatcaacagacactattgtacttatgtcttcggaacttgacacgaaaggtcaccggttcncgggtcacgcccaacggcccaaccctcgttcgtaacc

SEQ ID NO: 352198 - DNA, 512 bp, Homo sapiens
  misc_feature: GZ8MTXP01D98PS.52.38.D05.1.454.CMB.2.raw
  modified_base (335)..(335): a, c, t, g, unknown or other
  misc_feature (335)..(335): n is a, c, g, or t
  modified_base (417)..(417): a, c, t, g, unknown or other
  misc_feature (417)..(417): n is a, c, g, or t
  modified_base (476)..(476): a, c, t, g, unknown or other
  misc_feature (476)..(476): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcaggggatccctgagcgattccnctggctccaggtcagggcaacggtcacattggccatcagtgatcaggcagagacgagctgactattattgtacaattcaaanagaacacctattggtaaactttatgttcttcggaactgcggacctaaaggttcacgtcngggttcagcccaagcccaacccgacncgtcncttcc

SEQ ID NO: 352199 - DNA, 566 bp, Homo sapiens
  misc_feature: GZ8MTXP01EB9QS.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggccctgtgttggtgatgtataaagacactgagacggccctcgagggactccctgagcgattcctctggctccgaggtcagggaacaacggtcacattggccatcagtggagtcaggcaggaggacgaggctgactattattgtacaatcaaacagaccacctagtttggtaactttagtcgttcttacgggaacttggacgaaccgaaacgggttccacccggttccgttcggggttccaacggcccccgaaaacgggccccaaacccccgtacttcggtccttaacctttcccg

SEQ ID NO: 352200 - DNA, 610 bp, Homo sapiens
  misc_feature: GZ8MTXP01D44YV.52.38.D05.1.454.CMB.2.raw
  modified_base (240)..(240): a, c, t, g, unknown or other
  misc_feature (240)..(240): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaacgntatgcttattggtacagcagaagccggccaggcccctgtgttggtgatgtaataaagacactgagaggcccctgagggatcccctgagcgtatttcctcgtggctcccgagggtaccaagggaacgaaacggtcaactattcgggccagttcagttggacgtccgaggcaggaggtacgagctgactattattgtacaatcaaacagacaacctatttggtaaactttatcgttacttacgggaattaacggccgaaaccgtaaaggggttcccaaaccggttcccgttgggggttaccaacggggaacccccaaaaggggccccctaaaaaccccccgtacgttaccgttaacccttaaccgtttcccg

SEQ ID NO: 352201 - DNA, 558 bp, Homo sapiens
  misc_feature: GZ8MTXP01C7UH8.52.38.D05.1.454.CMB.2.raw
  modified_base (233)..(233): a, c, t, g, unknown or other
  misc_feature (233)..(233): n is a, c, g, or t
  modified_base (275)..(275): a, c, t, g, unknown or other
  misc_feature (275)..(275): n is a, c, g, or t
  modified_base (419)..(419): a, c, t, g, unknown or other
  misc_feature (419)..(419): n is a, c, g, or t
tcagcgcagtacgacacgaccggtgctcgatttagtatctgatagttgggtttgggggtccaggaggcagaactctgggtgtctcaccatggcctggatccctctcttctcccctcctcactctctgcacaggctctgaggcctcctatgagctgacacagccaccctcggtgtcagtcgtcccaggacagacggccaggatcacctgctctggagatgcattgaccaaacgntatgcttatggtacagcagaagccggcaggccctgtgttggngatgtaataaagacactgagacggccctcgagggactccgtgagcgattctctggctcgaggtcaaagggacaacggtcacagttggccatcagtggagtccgaggcaggaggacgaggctgactagttattgacaagtcaaanagacactagttgtaacttatcgtcttacggaaacttcggaacgaacccttaaagggttccaaaccggttccgtaggggttaccacgaccccgaaaacggccccaacccctactcggttcctaaccgttccgttaacccg

SEQ ID NO: 352202 - DNA, 530 bp, Homo sapiens
  misc_feature: GZ8MTXP01EKK74.52.38.D05.1.454.CMB.2.raw
  modified_base (491)..(491): a, c, t, g, unknown or other
  misc_feature (491)..(491): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
tcagcgcagtacgacacgaccggtgctcgatttagtatctgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgccaaacgatatgcttatggtacagcagagcggcaggccctgtgtggtgatgtataaagacactgagaggccctcgagggactcccgtagacgcgtactttcccgtctggctccgagggttacgaacggggaacaaacgggtcactattcgggcctaattcgaagtggagtccaggcaggaggacgaggctgactagttatgtacaatcaacagacacattggtacttatgtacttcggaatgcgacaaggttcacggtccngggttcacgcccaagcccaaacccncnctaacncgttcc

SEQ ID NO: 352203 - DNA, 535 bp, Homo sapiens
  misc_feature: GZ8MTXP01DF3CA.52.38.D05.1.454.CMB.2.raw
  modified_base (238)..(238): a, c, t, g, unknown or other
  misc_feature (238)..(238): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacagcagaagccggcagccctgtgtggtgatgtaataaagacactgagacggccctcgagggactccctgacgcgattcctctggctccgaggtacgagggaacaacggtcacatcggccatcagtgagtccgagcagaggacgtaggctgactattatgacaatacaaacagaacaccattggtaacttatgtacttcgggaacttgcgaccgtaaaggttccaaccgtcgttcgggttcacgaacccaacggcccaaacccgcttcgtccttaaccgttcccg

SEQ ID NO: 352204 - DNA, 556 bp, Homo sapiens
  misc_feature: GZ8MTXP01CWGFV.52.38.D05.1.454.CMB.2.raw
  modified_base (240)..(240): a, c, t, g, unknown or other
  misc_feature (240)..(240): n is a, c, g, or t
  modified_base (278)..(278): a, c, t, g, unknown or other
  misc_feature (278)..(278): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
tcagcgcagtacgacacgaccggtgctcgatttagtatctgatagttgggtttgggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtacagcagagcggcagccctgtgtggnatgtataaagacactgagacggccctgagggactcccgtgacgccgtattctctcggcctcccgaggtcacggggacaacgggtcacgattgggcccagtcaggtgagtccaggcaggaggacgaggctgacttattagttgtanaactacaanagaacacctaattggtacttaatgttcttaacggaacttcggacgaccgtaaagggtccaaacccggttcgttacggggtaaccaccggcccaacgggacccaacccctaacttcggtaacccc

SEQ ID NO: 352205 - DNA, 521 bp, Homo sapiens
  misc_feature: GZ8MTXP01DN45A.52.38.D05.1.454.CMB.2.raw
  modified_base (236)..(236): a, c, t, g, unknown or other
  misc_feature (236)..(236): n is a, c, g, or t
  modified_base (403)..(403): a, c, t, g, unknown or other
  misc_feature (403)..(403): n is a, c, g, or t
  modified_base (447)..(447): a, c, t, g, unknown or other
  misc_feature (447)..(447): n is a, c, g, or t
tcagcgcagtacgacacgaccggtgctcgatttagtatctgatagttgggctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgaccaaacgntatcggggttattggacagcagagccggcagccctgtgtgtgatgtaataaagacactgagacgccctgagggactcccgtgagcgtattctctggcctccgaaggtcgaagggacaaacgggtcacagttcggacatcagtggacgtcaggcaagaggacgaggcngaacttatattggtacaatcaacagacactagttagtacttagngttcttcggaactgacggacaaaggtccaaccgttcgttggccaagcccgaagcccaacccatcgttctaaccc

SEQ ID NO: 352206 - DNA, 768 bp, Homo sapiens
  misc_feature: GZ8MTXP01BT72Z.52.38.D05.1.454.CMB.2.raw
  modified_base (240)..(240): a, c, t, g, unknown or other
  misc_feature (240)..(240): n is a, c, g, or t
tcagcgcagtacgacacgaccggtgctcgatttagtatctgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgntatgtcttattggtaccagcagaagccgggccaggcccctgtgttggtgatgtaataaagacactgaagacggccctcgagggactcccgtgagcgtattcctcgtggctccgaggtacgaacggggaaccgaaacgggtcaaacgtagtttcgggacccctaagttccgaaggtttcgggaacgttaccccgaagggacccgaaagggtaaacggggaacccggaagggggtacccttagggtaaaacccgtttaaattttaaagttttacgggttaaaccgtaaaacgtttacccaaaaaaccgtaaacgggaaacccgaaacccctttaaagtttaacggggtttaaacccttttagttacggggttttaccctttaaccggggttaaaccgttaacgggaacccggttaaaccccggtaaacgggttcccgtaaacccggttcccgttacgggggttaccaaccggtaaccccgaaacgggaaccccaaaccccgtacgttacgtaaccttaaccgtttccccg

SEQ ID NO: 352207 - DNA, 563 bp, Homo sapiens
  misc_feature: GZ8MTXP01EWUTQ.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctcgagggactccctgagcgattccgtctggctccaggtcagggaacaacgggtcacattcggaccatcgagtggagtccgaaggcaagaggacgaggctagactattatgtacaatcaaacagaacacctagttacggtacttatcgttacttcggaaactgacgaaccgaaagggttccaaccgtccgttggggttccacggaaccccaacgggccccaaaccccacgttacgtcgttaaccgtttcccg

SEQ ID NO: 352208 - DNA, 562 bp, Homo sapiens
  misc_feature: GZ8MTXP01DN5UK.52.38.D05.1.454.CMB.2.raw
  modified_base (234)..(234): a, c, t, g, unknown or other
  misc_feature (234)..(234): n is a, c, g, or t
  modified_base (274)..(274): a, c, t, g, unknown or other
  misc_feature (274)..(274): n is a, c, g, or t
  modified_base (410)..(410): a, c, t, g, unknown or other
  misc_feature (410)..(410): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtacagcagaagccggcaggccctgtgtgngatgataagcactgagacggccctgagggactcccgtgacgcgtacttctcgtggcctccgaagggtccaaggggaactaaaccgggtcaacgtagttcgggaccatcgagtggacgtccgaggcaaggaggacgnggctgaactagttattggtactaaatcaaacagaacctacgtattaggtacttaagtgtcttacggaactcgacgaaaccgttagggtcctaccggttccgttggggttccaacgacccgaacggccccaacccgttactcgttcctaaccc

SEQ ID NO: 352209 - DNA, 721 bp, Homo sapiens
  misc_feature: GZ8MTXP01AE8MW.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccgggcacggccctgtgtggtgatgtataaagacactgagacggccctcgagggactcccgtgacgcgtacttcctcgtggcctccgaggtacgaacggggaacaaacgggtcaacgtagtttcgggccaagttccgaagggttcggaacggttcccgaaggggccgaagggaacgggacgggaagggtcctagggtaaccttaagtttaagtttggtaaccgtaaacttaccaaaaccgaaacggaacctaacccgtaagtttacgggttaaacctttagttccggtttaccgtttaaccgggtaaaccgtttaacggacccgggttaaacccgtaaaccggggttcccgtaaaccccgggtttcccggttacgggggttccaccgggtaacccccgaaacgggaacccccaaacccccgtacgttacccggttaaccgaaccccgttttccccgg

SEQ ID NO: 352210 - DNA, 542 bp, Homo sapiens
  misc_feature: GZ8MTXP01AV8AF.52.38.D05.1.454.CMB.2.raw
tcagcgcagtacgacacgaccggtgctcgatttagtatctgatagttgggtttggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggcaggcccctgtgtggtgatgataaagcactgagaggccctcgagggatccctgagccgattctctggcctaccaggtcagggacaacgggtcacattcgccatcagtggagtccaggcgagaggacgaggctagactattattgtacaatacaacagacacaattggtacttatcggttctcggaaacttgaccgaccgtaaagggtccaccggttcccgttaggggtccaacggccccgaaaagggcccccaaaacccctcgttcgtaacccc

SEQ ID NO: 352211 - DNA, 777 bp, Homo sapiens
  misc_feature: GZ8MTXP01DPY4X.52.38.D05.1.454.CMB.2.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (226)..(227): a, c, t, g, unknown or other
  misc_feature (226)..(227): n is a, c, g, or t
  modified_base (244)..(244): a, c, t, g, unknown or other
  misc_feature (244)..(244): n is a, c, g, or t
  modified_base (254)..(255): a, c, t, g, unknown or other
  misc_feature (254)..(255): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggacaccncgtnctgaganngatgtcaacaacatagntatagtcgannagagcgcgacgccgcgtgtgtgatagtataaagaacactagtagacggacccgttccagggtaggtaccctccgtagacggtaccttacgttccgtcggtccgtaccctaaccggggttacgtaacggggtaaaccggaaacccgggttaaacccggtaccaaacgtttcggggtaccggaacttaccgtacgggttaggggtaacggtcccgaaccggaaggaccggtaaaggggacggaaacggggttctacggtaaagttaaactttaaggttttcggttaaaccgaaacttaaaccggtaaaccctaaaagggaacccctaaacccgttaaacgttttaaagggttttaaaccgggtttaaacctttggttaccggttttaacccggaaaaaccgggttcttaccgggaaacccgttaaaccggtacggtaccccgttacccgggtttcggacggggtaacccaacccgtaaacccgggaaccccaaccccccgttaacttccggttccgttaacccc

SEQ ID NO: 352212 - DNA, 686 bp, Homo sapiens
  misc_feature: GZ8MTXP01EO0QR.52.38.D05.1.454.CMB.2.raw
  modified_base (226)..(226): a, c, t, g, unknown or other
  misc_feature (226)..(226): n is a, c, g, or t
  modified_base (291)..(291): a, c, t, g, unknown or other
  misc_feature (291)..(291): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgatatgcttatggtaccagcagaacgccggccacggcccctgtgttggngatgtaataaagacactgagacggccctacgaggactcccgtgacgccgtattctcgtcgcctaccgagggtcgacgggaacaacgggtacaacgtacgttgggaccctagtaccgtaggttacgggacgtacccgaagggccgaagggaacgggaccggaaggccgtaggtaacgtttaatttacgggttacgttaaacgtaaacttaccaaaacgtaacgtaaaccctaacccgtaaagttttacggttaaactttaacgttcggttacccgttaacggtaaacgtttcggaacccgttaaaccgtaaacggtcccttacccggttccggttacgggtaaccgacgaaccccgaaacgggaccccttaaaccccgtaacgtttcgtaaccccg

SEQ ID NO: 352213 - DNA, 783 bp, Homo sapiens
  misc_feature: GZ8MTXP01AU9P5.52.38.D05.1.454.CMB.2.raw
  modified_base (243)..(243): a, c, t, g, unknown or other
  misc_feature (243)..(243): n is a, c, g, or t
tcagcgcagtacgacacgaccggtgctcgatttagtatctgatagttgggtttgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattcgaccaaacgntatgtcttattggtacagcagaacgccggccacggccctgtgttggtgatagtataaagacactgagacggccctcgagggactccccgtagacgcgtactttcctcgtggcctccgaggtaccgacgggaaccaacgggtccaacgtacgttcgggaccctagtccgagggttcggaacgttccccgaaggggccgaaggggaacggggacgggaaacgggtcgttaacgggtaacctttaagtttaacgtttacggttaacgtaaaacgtttaccaaaacgaacggtaaaccaacccgttaagtttacgggtttaaaccttttagttacggtttacccgtttaccggggtaaaaccgttaacggtaaccccggttaaacccgttaaaacggggttaccccgtaaaccccgggtttccccggttaccgggggtttaccccttaaacccggggtaaccccccggtaaaacccggggaaccccctaaaacccccccgtaacggtttcccgggtaaccccttaaaccccgtttttcccccgg

SEQ ID NO: 352214 - DNA, 711 bp, Homo sapiens
  misc_feature: GZ8MTXP01DJLEM.52.38.D05.1.454.CMB.2.raw
  modified_base (312)..(312): a, c, t, g, unknown or other
  misc_feature (312)..(312): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacacgccaccctggtgtcagtcgtccccaggacaggacggccaggatcacctgctcgtaggagatgactagttacgacccaaacgtatatgtcttattcggtaccagcaagacgccggcacggcccctggtgttggtgatagtaanaaagacacgtaggagacggccctacggaggtacctcccgtaggacgtaccgtacttcgtcgtcggtcctaacccggagggtccgaaacggggaccgtaaacgggtccaacgtacgttcgggaccctagtacgaaggttgggaacgtccggaagggaccgaagggacgggaaccggacggtcctaacggtacttaagtttagttcggtaactaaactacaaaaccgttaacgaacctaccgttaagtttacggttaacttacgttacgttacgtttccgggtaaacttcggtaaacccgaaaccggtaaccggtcgttaaccccggttcggttacgggtaacccaaccgggtaaccccaaaccggggaccccttaaccccgtaacgttccggttaacccc

SEQ ID NO: 352215 - DNA, 574 bp, Homo sapiens
  misc_feature: GZ8MTXP01ELPP5.52.38.D05.1.454.CMB.2.raw
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
  modified_base (337)..(337): a, c, t, g, unknown or other
  misc_feature (337)..(337): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagagccggcaggccctgtgtggngatgtaataaagacactgagacggccctgagggactcccgtgacgccgtattcncgtggcctacccgaggtccgaagggaccaaacgggtcacgtagttcggaccatcgagtggacgtccgaggacaggaggacgagctagtaactagttagttgtactaatcgaaacagacactattcgtacttagtgtcttcggaacttggaccgaacgtaaacggtcccgttaacccgttccgttacggggaaccacggaaccccaaacggccccaaaccccgtaacttcggtaaccc

SEQ ID NO: 352216 - DNA, 543 bp, Homo sapiens
  misc_feature: GZ8MTXP01EQIDD.52.38.D05.1.454.CMB.2.raw
  modified_base (311)..(311): a, c, t, g, unknown or other
  misc_feature (311)..(311): n is a, c, g, or t
tcagcgcagtacgacacgaccggtgctcgatttagtatctgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccgggccaggcccctgtgttggtgatgtaataaagacactgagacgcctnagggatcctgagcgattcctctggctccgaggtacagggaacaacgggtcactattcggaccatcagtggagtccgaggcaggaggacgaggctagactattatgtacaatacaaactagacactattaggttaacttagtgttctacggactgccgacgaaaggttccaaccgtccgttgggttcacgaacccgaacggccccaaaccctacttcgtccttaacgttcccg

SEQ ID NO: 352217 - DNA, 560 bp, Homo sapiens
  misc_feature: GZ8MTXP01C2V8M.52.38.D05.1.454.CMB.2.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (315)..(315): a, c, t, g, unknown or other
  misc_feature (315)..(315): n is a, c, g, or t
tcagcgcagtacgacacgaccggtgctcgatttagtatctgatagttgggtttgggggtccaggaggcagaactctgggtgtctcaccatggcctggatccctctcttctccccctcctcactctctgcacaggctctgaggcctcctatgagctgacacagccaccctcggtgtcagtcgtcccaggacagacggcaggatcacctgctntggagatgcattgaccaaacgntatgcttatggacagcagaacgccggcacgccctgtgtgtgatagtaataaagacacgtgagacgccctagagggactccgngagcgtattctccgtggctccgaggcgaaagggacaacggtcaactagttcggaccattcgaggtggagcccgaaggcgaaggacggtacgaggctagaacttagtattgacaaagacaacacacactagttagttacgttacgtacgtcgtacgtacgtacgaacgaacgacgtacgttaccgtccgtcggacgaccgacccgaaccgacccaaccctacctacgttacctccgttccgtcccg

SEQ ID NO: 352218 - DNA, 553 bp, Homo sapiens
  misc_feature: GZ8MTXP01EFLLH.52.38.D05.1.454.CMB.2.raw
  modified_base (242)..(242): a, c, t, g, unknown or other
  misc_feature (242)..(242): n is a, c, g, or t
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccacccctcggtgtcagtgtccccaggacagacggccaggatcacctgctctggagatgcattgccaaaccgntatgcttatggtacagcagagccggcaggcccctgtgttggngatgtataaagacactgagacggccctnagggatcccgtgacgcgattctctggctccaggtcagggacaacgggtcacagttggcccatcgagtggagtccagggcaggacggacgaagctgacttattagttgtcaatcaaacagacacctaaagttggttaacttagtcgtctttcgggaaacttggaccgttaaccaaacggggttccaacccgttccgttggggtccacgccccaaacgggcccaaaccccaacttcgtaaccc

SEQ ID NO: 352219 - DNA, 642 bp, Homo sapiens
  misc_feature: GZ8MTXP01EC0BA.52.38.D05.1.454.CMB.2.raw
  modified_base (240)..(240): a, c, t, g, unknown or other
  misc_feature (240)..(240): n is a, c, g, or t
  modified_base (285)..(285): a, c, t, g, unknown or other
  misc_feature (285)..(285): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgtcttattggtaccagcagaagccggcaggccctgtgttggnatgtataaagcactgagacggcctcgagggactcccgtgaagcgtactttccgcgtggctccgaggtaccaagggaacaaacgggttcactaagttcgggaccctaagtccgaaggttggacgtccgaggcaaggaggacgaggctagtactattagtcgtacgaattacaaacaggaaacctacctaagtttcggttaaacctttagtcggttaccgtttaccggaaacgttcggaaccgaaaccggtaaacgggttccctaaacccgggttccgttcgggggttccaaccggtaacccccgaaacggggtcccctaaaacccccgtcgttaccgttaacccgttaaccgttcccg

SEQ ID NO: 352220 - DNA, 596 bp, Homo sapiens
  misc_feature: GZ8MTXP01DPK1F.52.38.D05.1.454.CMB.2.raw
  modified_base (235)..(235): a, c, t, g, unknown or other
  misc_feature (235)..(235): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtgtcccaggacagacggccaggatcacctgctctggagatgcattgacccaaaacgntatgcttattggtaccagcagaagcccggcaggcccctgtgttggtgatgtaataaagacactgagaggccctnagggatccctgagcgacttctctggctccgaagggtcaagggacaacgggtcacgattcggcancagtggagtccgaggcaaggacggaacgagggactggaacttaatttagttagggtacctaaattaccccaaaacgtaacgaactaacgtaagtttacgttaactttagtcgttacgttacggaactcggaccgtaaccgttaacggtccctaccggttcgttcgggttaccgaaccggacccgaaccggaccccaacccgttacgtccgttaaccgtaaccg

SEQ ID NO: 352221 - DNA, 574 bp, Homo sapiens
  misc_feature: GZ8MTXP01BGMVM.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggccaggccctgtgtggtgatgtataaagcactgagaggccctagagggactccctgacgcgacttccctcgtggcctcccgaggtcgaagggaaccaacggtcacattcgggaccatcagtggaagtccgaggcaggaggacgaggcagactattattgtacaattacaaacgagaccaacgtatttcggtaatttagtgttacgtttaccggaaacttgacgttaaccaaacgggttctaacccgtcgttgggttccaacgggcccaacgggaacccctaaccccacgttcgtccgttaaccttcccg

SEQ ID NO: 352222 - DNA, 545 bp, Homo sapiens
  misc_feature: GZ8MTXP01B48ZK.52.38.D05.1.454.CMB.2.raw
  modified_base (423)..(423): a, c, t, g, unknown or other
  misc_feature (423)..(423): n is a, c, g, or t
  modified_base (528)..(528): a, c, t, g, unknown or other
  misc_feature (528)..(528): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccgggccacggcccctgtgttggtgatgtataaagacactgagacggccctcgaggactccctgagcgattcctctggctccgaggtcagggaacaacgggtcacattcggcagtcagtggagtccgaggcaggaggacgaggctagactattatagntaaatcaaacagaaccaccgtattaggtacttatgtctttacggaacttggcaaccgaggttccgtaaccgtcgttggttccacgcccgaacggcccaacccctnttacgtccaacttcccg

SEQ ID NO: 352223 - DNA, 601 bp, Homo sapiens
  misc_feature: GZ8MTXP01B3J6A.52.38.D05.1.454.CMB.2.raw
  modified_base (240)..(240): a, c, t, g, unknown or other
  misc_feature (240)..(240): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtacagcagagccggcacggccctgtgtggtgatgtataaagacactgagacggcctcgagggactccctgagcgtattccctcgtgctccgaggtacgagggaacaacgggtcacagttcggaccatcgagtggagtccgaggacaggacggacggaggctagacttattattcgtacaaatcaaacagaacctacctagttacggttaacttgttcgttacgtaccggaacttcgaccgttaaacccgtaagggttccctaacccgggttccgttacggggttcccaacggaaccccgaaacgggtaaccccaaaacccctcggttccgtaaccgttaaccgtttcccg

SEQ ID NO: 352224 - DNA, 568 bp, Homo sapiens
  misc_feature: GZ8MTXP01BUMZS.52.38.D05.1.454.CMB.2.raw
  modified_base (222)..(222): a, c, t, g, unknown or other
  misc_feature (222)..(222): n is a, c, g, or t
  modified_base (548)..(548): a, c, t, g, unknown or other
  misc_feature (548)..(548): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgatatgcttatggtaccagcagaagccggcaggccctgtgtggtgatgtataaagacactgagaggcccctcgagggactccccgtgagcgtatttcctctggctccgaggtccgagggaacaacgggtcactagttcggacctagtcgagtggagtccgaggcaggaggacgaggctagactattattgtacgaatcaaacagaccacctagttcggtaactttatgttcttacgggaactggcgacccgtaaaggttccgtaacccgtccgttcggggttcacggccccgaaacggccccaaaccccgnttcgtcccaaccgtttcccg

SEQ ID NO: 352225 - DNA, 598 bp, Homo sapiens
  misc_feature: GZ8MTXP01DDHTJ.52.38.D05.1.454.CMB.2.raw
  modified_base (239)..(239): a, c, t, g, unknown or other
  misc_feature (239)..(239): n is a, c, g, or t
tcagcgcagtacgacacgaccggtgctcgatttagtatctgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaacgntatgcttattggtacagcagaagccggcaggccctgtgttggtgatgtaataaagacactgagacggccctcgagggactcccgtgagcgtattccctctggctccgaggtccgaagggaacaaacgggtcaactagttcggcctatcgagtgggagtccgagggcaaggaagggacgaggctagaacttattattcgtacaaatcaaacagaaccaccgtagttcggtaactttagtgttcttacggaacttaacggaccgttaaaccgtaaacggttccgtaaacccggttccgttacgggttccaacggaaccccaaacgggcccccaacccgacttcgtaaccgaactttccccg

SEQ ID NO: 352226 - DNA, 533 bp, Homo sapiens
  misc_feature: GZ8MTXP01DMYL2.52.38.D05.1.454.CMB.2.raw
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgcttattggtaccagcagaagccggcaggcccctgtgtggtgatgtataaagacactgagaggccctcgagggatccctgagcgattctcgtggcctccgaagggtcaaggggacaaacgggtcactattggccatcgagtggagtcaggcaaggaggacgaggctgactattattggtacaatcaaacagacactattaggtacttatgtcttcgggaaactgcgtaccaaggtccaccgttccgttgggttaccaacgacccaacggccccaaccccgactcgttctaaccc

SEQ ID NO: 352227 - DNA, 613 bp, Homo sapiens
  misc_feature: GZ8MTXP01D26HO.52.38.D05.1.454.CMB.2.raw
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacgccagatcacctgctctggagatgcattcgaccaaaccgntatgcttatggaccagcagaagccggcaggccctgtgtgngatgtataaagacactgagacgccctagaggactcccgtagacgtcccgatttctcgtcggctaccgaggtcgaagggtaacaacgggtcacgtagttcgggaccctagtcgaggtggacgtccgaaggacgaggaacgggacgaagggtacctaggtaaacttagtttagtttacgtaacctaaagtaccaaaacgacgaacctacctaagtttggtaacctttaagttcgtaccgtttaacggaaacttcggaccgttaaaccgaaacggtccaacccgttcgacgggtaacacgaacccaacggccccaaaccctcgttcgtaacccg

SEQ ID NO: 352228 - DNA, 648 bp, Homo sapiens
  misc_feature: GZ8MTXP01EHIKW.52.38.D05.1.454.CMB.2.raw
  modified_base (290)..(290): a, c, t, g, unknown or other
  misc_feature (290)..(290): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgtatatgcttattggtaccagcagagccgggcaggcccctgtgttggngatgtataaagacactggagacggccctcgagggactcccgtgacgtccgtattctcgtcggcctacccgaggtcgagggaacaacgggtcacgtagttcggccagtacgaggtggacgcccgaagggaccgaagggacgggaacggagggtacctaggtaaccttaagtttaggtttaggttaacctaaacttaccgaaaacaacgtaacctaaccttaagtttacgggttaacctttaagtttcgttaccgttaacggtaaactttcggaacccgttaacgtaaacggtcccaacccggttcgttacgggtaaccgacgaacccgaacggaccccaaacccctcgttcgtaacccc

SEQ ID NO: 352229 - DNA, 588 bp, Homo sapiens
  misc_feature: GZ8MTXP01DAFCF.52.38.D05.1.454.CMB.2.raw
  modified_base (242)..(242): a, c, t, g, unknown or other
  misc_feature (242)..(242): n is a, c, g, or t
  modified_base (287)..(287): a, c, t, g, unknown or other
  misc_feature (287)..(287): n is a, c, g, or t
tcagcgcagtacgacacgaccggtgctcgatttagtatctgatagttgggtttgggggctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgccaaaccgntatgcttattggtaccagcagaagccggcaggcccctgtgttggngatagtataaagacactgagacggccctgagggactacccgtgacgccgtattcgtcgtcggctacccgaggtcgagggaaccaacgggtcacagttggccatcaggtggacgtccaaggcaggaggacgaggctgaacttattattgtacaaatcaaacagacacctaattcggtaacttagtgttcgttaacggaaacttcggaccgaccgtaaacgggtcccttaacccggttccgttacggggtaacccacggaaccccgaaaccgggccccaaaccccgtaacttcggttaacccc

SEQ ID NO: 352230 - DNA, 520 bp, Homo sapiens
  misc_feature: GZ8MTXP01EIURO.52.38.D05.1.454.CMB.2.raw
  modified_base (240)..(240): a, c, t, g, unknown or other
  misc_feature (240)..(240): n is a, c, g, or t
  modified_base (478)..(478): a, c, t, g, unknown or other
  misc_feature (478)..(478): n is a, c, g, or t
  modified_base (503)..(503): a, c, t, g, unknown or other
  misc_feature (503)..(503): n is a, c, g, or t
tcagcgcagtacgacacgaccggtgctcgatttagtatctgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgntatgcttattggtaccagcagaagccgggccaggcccctgtcgttggtgatgtataaagacactgagacgcctcagggactcccgtgagcgattcctctggctcaggtcagggaacaacgggtcacattcggccatcagtggagtccgaggcaggaggacgaggctgactattatgtacatacaacagacactattggactttatgtacttcggactgcgactaaggttcaaccgtcncgggttcacgcccaggcccaacccncttacgtcaacgttccc

SEQ ID NO: 352231 - DNA, 572 bp, Homo sapiens
  misc_feature: GZ8MTXP01E337S.52.38.D05.1.454.CMB.2.raw
  modified_base (282)..(282): a, c, t, g, unknown or other
  misc_feature (282)..(282): n is a, c, g, or t
  modified_base (447)..(447): a, c, t, g, unknown or other
  misc_feature (447)..(447): n is a, c, g, or t
tcagcgcagtacgacacgaccggtgctcgatttagtatctgatagttgggtttggggtgggtccaggaggcagaactctgggtgtctcaccatggcctggatccctctacttctcccctcctcactctctgcacaggctctgaggccctcctatgagctgacacagccaccctcggtgtcagtcgtccccaggacagacggccaggatcacctgctctggagatgcattcgaccaaacgatatgcttatggtaccagcagagccggcacgccctgtgtggtnatgtataaagacacgtgagacgccctgaggactccctgacgcgtattccctcgtggctccgaggtacgaacggggaactaacggtcaactagtcggacccatcaggtggacgttaccgaggcgaggaggacgaggctagacttattattgtacaactacaaacgnaaccacctagttaggttacttatgttacgttacgactgaccgaccgtaaagggttccaaccggtccttcggggttcaaccgccccgaaacggccccaaacccctcttagtccccaactttccccg

SEQ ID NO: 352232 - DNA, 585 bp, Homo sapiens
  misc_feature: GZ8MTXP01C82GA.52.38.D05.1.454.CMB.2.raw
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (436)..(436): a, c, t, g, unknown or other
  misc_feature (436)..(436): n is a, c, g, or t
tcagcgcagtacgacacgaccggtgctcgatttagtatctgatagttgggtttggggggtccaggaggcagaactctgggtgtctcaccatggcctggatccctctcttctcccctcctcactctctgcacaggctctgaggcctcctatgagctgacacagccaccctcggtgtcagtcgtcccaggacagacgcaggatcacctgctctgganatgactattaaccaaacgtntatgcttattgtaccagcagaagccggcaggccctgtgtggtgatgtaataaagacactgagaggccctacgagggactcccgtgagcgtacttctcgtcggctcgaggtcgagggaaaccaacgggtcaactagttcgggacctatcgaggttcgggacgtccgaggcgaaggaggacgaggctggtaactattattganaaactacaaacgaagaccacctagttcggtacttagtcgttcttacggaacttgaccgtaacgtaacgttccgtaccgttcgttcggacaccgccgaaacggaaccccaacccgaacgttcgacccttacttccttaaccgttcccccg

SEQ ID NO: 352233 - DNA, 585 bp, Homo sapiens
  misc_feature: GZ8MTXP01DKQJH.52.38.D05.1.454.CMB.2.raw
  modified_base (291)..(291): a, c, t, g, unknown or other
  misc_feature (291)..(291): n is a, c, g, or t
  modified_base (437)..(437): a, c, t, g, unknown or other
  misc_feature (437)..(437): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgcttattggtaccagcagaagccgggcacggcccctgtgttggngatgtaataaagacactgagacggccctgagggctccctgacgccgtattctcgtggctaccgaggtcgagggacaacggtcactagtgccatcagtggagtccaggcaggaggacgagctagattattattgtacaatcaaacanacactagttcgtacttatcgttcttaacgggaaacttcggaccgaaccgtaaacgggtcccaaccccgggttccgttaacgggggttccaaaccggaacccccgaaaaccgggtacccccaaaaccccggtcctttaacggtaacccc

SEQ ID NO: 352234 - DNA, 540 bp, Homo sapiens
  misc_feature: GZ8MTXP01BV47Q.52.38.D05.1.454.CMB.2.raw
  modified_base (237)..(237): a, c, t, g, unknown or other
  misc_feature (237)..(237): n is a, c, g, or t
tcagcgcagtacgacacgaccggtgctcgatttagtatctgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggccaggcccctgtgtggtgatgtataaagacactgagaggccctcgagggatccctgagcgattcctctggctccgaggtcagggcaacggtcacatggccaatcagtgagtccgaggcaggaggacgtaggctgactatattgtacaatcaaacagacaccagttggtaaccttgtcgtcttacgggaactgccgacctaaagggttccaacccggttcttcggggttcacggccccaaacggccaacccccgcttaccgtcgttaaccgttcccg

SEQ ID NO: 352235 - DNA, 596 bp, Homo sapiens
  misc_feature: GZ8MTXP01EKGP2.52.38.D05.1.454.CMB.2.raw
  modified_base (239)..(239): a, c, t, g, unknown or other
  misc_feature (239)..(239): n is a, c, g, or t
  modified_base (280)..(280): a, c, t, g, unknown or other
  misc_feature (280)..(280): n is a, c, g, or t
tcagcgcagtacgacacgaccggtgctcgatttagtatctgatagttgggctgtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctcgtggagatgcattgaccaaaacgntatgcttatggtaccagcagaagccggcacgccctgtgtgngatagtaataaagcatgagacgccctgagggactcccgtgacgcgtacttctacgtgcctacccgaaggtacgaacgggaactaaaccgggtcaacgtagttcgggacaatcgagtggacgtccgaggacgaggaggacgagtctagtaacttattagttaggtactaaataccaaacacgaactacctagttacgttataagttcgtccgttacgaacttcggaccgtaacgttacggtccctaccgttaccgttcgggttacccgaacggaccccaacggaccccaaccccgttacgtccgttaaccgtaaccc

SEQ ID NO: 352236 - DNA, 648 bp, Homo sapiens
  misc_feature: GZ8MTXP01BKE93.52.38.D05.1.454.CMB.2.raw
  modified_base (218)..(218): a, c, t, g, unknown or other
  misc_feature (218)..(218): n is a, c, g, or t
tcagcgcagtacgacacgaccggtgctcgatttagtatctgatagttgggtttggggggtccaggaggcagaactctgggtgtctcaccatggcctggatccctctcttctcccctcctcactctctgcacaggctctgaggcctcctatgagctgacacagccaccctcggtgtcagtcgtccccaggacagacggccaggatcacctgctctgganatgcattaccaaacgatatgcttatgtacagcagaagccggcaggccctgtgttggtgatgtaataaagacacgtgacgacggccctcgagggactcccgtggacgcgtattctcgtcggctcgaggtcgacgggaacaacggtcactagttcggaccatcgaggtcggacgtaccgaggacgaggaggacggagggccttaggtacttaagttagttacgtactaaacttacgaaacgaacggtaacctaccgttaagtttacggttaacctttagttacggttacgtttacgggaacttcgggaacccgtaacgtaaacgggttccgtacccggttccggtagggttaccaaccggccccgaaaccgggtccccaaaaccccgtccgttacggtacccttacccgttcccgttccccgtttccccccg

SEQ ID NO: 352237 - DNA, 535 bp, Homo sapiens
  misc_feature: GZ8MTXP01C6SC1.52.38.D05.1.454.CMB.2.raw
  modified_base (243)..(243): a, c, t, g, unknown or other
  misc_feature (243)..(243): n is a, c, g, or t
  modified_base (415)..(415): a, c, t, g, unknown or other
  misc_feature (415)..(415): n is a, c, g, or t
  modified_base (436)..(436): a, c, t, g, unknown or other
  misc_feature (436)..(436): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagggatcacctgctctggagatgcattgaccaaacgntatgcttatggtacagcagaagccggcaggcccctgtgttggtgatgtataaagacactgagacggccctcgagggactccccgtgacgcccgtattctcgtcggcttaccgaggtcgagggacaacgggtcacattggaccatcaggtgagtccaggcagaggacgaggcngactattatgtacaatacaanagacactattcgtacttagtgttcgtcgtaaacttggcacgtaaacgtcacgttccgttagggcaacgcccaacggacccaacccgtcgttaacgtccc

SEQ ID NO: 352238 - DNA, 745 bp, Homo sapiens
  misc_feature: GZ8MTXP01DEFVF.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattcgaccaaacgatatgcttattggtacagcagaagccggcacggccctgtgtggtgatgtaataaagacacgtagagacggccctacgaggggactcccgtagacgcgtacttccctcgtggcctccgaggtaccgacgggaacaaaccgggtcaacgtacgttcgggaccctagtaccgaagggttaggaccgtacccggaagggacgaaacgggaacgggaccgagggtccgtaaggtaaccttaaagtttaagtttcggtaacgtaaacgtttaaccaaaacgaacggtaaccctaaacccgttaggttttaacgggtttaaacctttagttacggtttaccggtttaacgggaaaccgtttcggaaacccgggttaacccgtaaacggggttacccgtaaaccccggtttcccggttcggggttacccgaaacccgggtaaccccgtaaaacccgggaacccccgtaaaaccccctaccgggtttaccgtcccttaaaccccgggttttccccg

SEQ ID NO: 352239 - DNA, 591 bp, Homo sapiens
  misc_feature: GZ8MTXP01A1WKP.52.38.D05.1.454.CMB.2.raw
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
tcagcgcagtacgacacgaccggtgctcgatttagtatctgatagttgggtttggggggtccaggaggcagaactctgggtgtctcaccatggcctggatccctctcttctcccctcctcactctctgcacaggctctgaggcctcctatgagctgacacagccaccctcggtgtcagtcgtccccaggacagacggccaggatcacctgctctgganatgcattgaccaaacgntatgtcttattggtaccagcagaagccggcaggcccctgtgttggtgatgtaataaagacactgagaggccctcgagggactcccgtgacgcgattctcctggctcgaggtcgaagggacaacgggtcacgtagttcgggacctatcgagtcggagtccgagggcgaggaggacgaggctagacttattatgtacaagtacaaacagacaacctagttggtactttagtcgttaccgttcggtaactggaacgtaaccgttaaacgggtccttaacccggtcgtcgggttccgaccggaccccgaaacgggaccccaaacccgtaccgtcgttacctaaccttccgtttaaccccg

SEQ ID NO: 352240 - DNA, 680 bp, Homo sapiens
  misc_feature: GZ8MTXP01BO3A5.52.38.D05.1.454.CMB.2.raw
  modified_base (236)..(236): a, c, t, g, unknown or other
  misc_feature (236)..(236): n is a, c, g, or t
  modified_base (281)..(281): a, c, t, g, unknown or other
  misc_feature (281)..(281): n is a, c, g, or t
tcagcgcagtacgacacgaccggtgctcgatttagtatctgatagttgggctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgaccaaacgntatgcttatggtaccagcagaacgccggcacggccctgtgttggngatgtaataagacatgagcggccctgagggactcccgtgacgcgtacttctcgtcggctccgaagggtcgaaggggaacctacgggtcacgtagttcgggactagtcgaaggtcggacgtccgaggacgaagggacgggacgagggtacctaggtaacttaagtttacgtttaggggtaacctaaacgttaccaaaacgaacggtaacctaacccgttagttttacgggttaactttacgttcggtttacccggtttacggaaacgtttcggaaccgtaaaccgttaaacgggttcccgtaacccgggtttccggttacggggttaccgaacccgggtacccccgaaacgggtaccccccaaaaccccgttacggtttccggttaacctttaacccccg

SEQ ID NO: 352241 - DNA, 504 bp, Homo sapiens
  misc_feature: GZ8MTXP01CS0E8.52.38.D05.1.454.CMB.2.raw
  modified_base (329)..(329): a, c, t, g, unknown or other
  misc_feature (329)..(329): n is a, c, g, or t
  modified_base (416)..(416): a, c, t, g, unknown or other
  misc_feature (416)..(416): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtacagcagagccggcaggcccctgtgtggtgatgtataaagacactgagagccctgaggatccctgagccgattcnctggctccgaggtcagggacaaacgggtcacattgccatcagtggagtccaggcagaggacgaggctgactattatgtcaatcaaangacacattggtacttatcgtcttcggaacttgacgaccgaaaggtcaccgttcttgggtcagcccgaagcccaaccctcttcgtaacc

SEQ ID NO: 352242 - DNA, 543 bp, Homo sapiens
  misc_feature: GZ8MTXP01C7XDS.52.38.D05.1.454.CMB.2.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (287)..(287): a, c, t, g, unknown or other
  misc_feature (287)..(287): n is a, c, g, or t
  modified_base (324)..(324): a, c, t, g, unknown or other
  misc_feature (324)..(324): n is a, c, g, or t
  modified_base (441)..(441): a, c, t, g, unknown or other
  misc_feature (441)..(441): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctctgganatgcattcgaccaaacgntatgcttatgtaccagcagaacgcggccaggccctgtgttggnatgtaataaagacacgtgagacggcctgaggctccgngagtccgtattctcgtcgcctaccgaggtcgaaggggacaacgggtcacgagtcggaccatcgaggtggacgtcgaggacaggaggacgagctagactattagtagtacaatacaanacgactactagtagtactatgtcgtaacggtaacttgaccgacgaacgtcttaaccgcgttacgggcaaccgcccgaaacgcccaacctaacgttcgtaacc

SEQ ID NO: 352243 - DNA, 538 bp, Homo sapiens
  misc_feature: GZ8MTXP01A3HWK.52.38.D05.1.454.CMB.2.raw
  modified_base (237)..(237): a, c, t, g, unknown or other
  misc_feature (237)..(237): n is a, c, g, or t
  modified_base (278)..(278): a, c, t, g, unknown or other
  misc_feature (278)..(278): n is a, c, g, or t
tcagcgcagtacgacacgaccggtgctcgatttagtatctgatagttgggtttggggggtccaggaggcagaactctgggtgtctcaccatggcctggatccctctcttctccccctcctcactctctgcacaggctctgaggcctcctatgagctgacacagccaccctcggtgtcagtcgtccccaggacagacggccaggatcacctgctctggagatgcattcgaccaaacgntatgcttatggtaccagcagaagccggcaggccctgtgtgngatgtataaagacatgagacggccctgagggactcccgtgacgcgattctcctggctccgaggtcgaaacgggacaacggtcactagttcgggccatcgagtggacgtccgaggcaggaggacgaggctagacttattatagtacaatcaaacagacacctagttaggtacttagtcgtcttacggactgaaccgacttagggtccaccgtcgtgggttcacgcccgaacggcccaacccatcgacctcgttcgttcccg

SEQ ID NO: 352244 - DNA, 765 bp, Homo sapiens
  misc_feature: GZ8MTXP01DLRX8.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctggagatgcattgaccaaacgatatgcttattggtacagcagaagccggccaggcccctgtgttggtgatgtaataaagacacgtgaagacggccctcgagggactcccgtgagcgtattccctcgtggcctccgaggtaccgaagggaaccgaaacgggtcacgtagtttcgggacccaagtccgaggttcggaacggtacccgaagggaccgaaggggaacgggaacgggacgggtacccgttagggtaaaccctttaaagtttaagtttacggttaaccgtaaaacgttacccaaaaaaccgtaaacgggaaaccctaaacccccgttaaagtttttacggggtttaaacccttttaaagtttcgggtttaacccggtttaaccgggtaaaccgttaacgggtaacccggaaacccgtaaaacggggttccccgtaaaccccgggtttccccgttacgggggttcccgaaccggtaacccccgaaaacgggtaacccccaaaaccccccgtaccgttcggttaaccccgttaaccgttttcccccg

SEQ ID NO: 352245 - DNA, 646 bp, Homo sapiens
  misc_feature: GZ8MTXP01CC0P0.52.38.D05.1.454.CMB.2.raw
  modified_base (242)..(242): a, c, t, g, unknown or other
  misc_feature (242)..(242): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgacccaaacgntatgcttattggtaccagcagaacgccggccacggcccctgtgttggtgtatagtaataaaagacactagagacggccctacgagggactccctgagcgtattccctcgtggctccgaggtacgaagggaaccaaacgggtcaacgtacgttcgggacctatcgtaggtggacgtccgaggctaagggaacggacggagtctaggaacttaagtttattcggtaactaacgttacaaacgaacgtaaccaccctaagtttacggtaaacctttagtacggtttccttacgggaacttcggaaccgaaccgtaacggggttcctaacccggttcgttacgggttcgaacgtccccgaaacgggtaaccccaaacccctcggttaccgttccaacccgttttcccg

SEQ ID NO: 352246 - DNA, 613 bp, Homo sapiens
  misc_feature: GZ8MTXP01AUCMS.52.38.D05.1.454.CMB.2.raw
  modified_base (299)..(299): a, c, t, g, unknown or other
  misc_feature (299)..(299): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcaattcgaccaaaaccgatatgcttattggtaccagcagaagccgggcaggcccctgtgttggtgatgtanaaagacactgagacgggccctcgagggatccctggacgccggattctctgggccttaccgaggtcgaggggaccaacgggtcactagttggccatcaggtggagtccgaggcaggaggacgagggctggactagttagttggtacaaatcaaacacgaaccaaccgtaatttcgggtaacctttaagtcgttacgtttaacggaaacgttggacccgttaaccgtaaacgggttcccaacccggtttcccgttagggggttcccacggaaccccgaaacgggacccccaaaccccctaacgttcggtaaccccg

SEQ ID NO: 352247 - DNA, 615 bp, Homo sapiens
  misc_feature: GZ8MTXP01DETPC.52.38.D05.1.454.CMB.2.raw
  modified_base (245)..(245): a, c, t, g, unknown or other
  misc_feature (245)..(245): n is a, c, g, or t
  modified_base (288)..(288): a, c, t, g, unknown or other
  misc_feature (288)..(288): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgntatgcttatggtaccagcagagccggcaggcccctgtgttggngatgtaataaagacactgagacggccctcgagggactcccgtgacgccgtacttctcgtcggctaccgaggtcgagggaccaacggtcacgtagttcggaccagtcgaggtggagtccgaggacaggaggacgaggctagtaacttagtttagttgtactaaacttacaaactacgactaaccgtaagtttacggttaacctttagttcgttaccgttaacgggtaaacttcgggaccgaacgtaaacggtcccaaccggttccgttacgggtaaccaaccggaaccccgaacgggaccccttaaacccgtcgttaacgttaacccg

SEQ ID NO: 352248 - DNA, 599 bp, Homo sapiens
  misc_feature: GZ8MTXP01CJP0Q.52.38.D05.1.454.CMB.2.raw
  modified_base (236)..(236): a, c, t, g, unknown or other
  misc_feature (236)..(236): n is a, c, g, or t
tcagcgcagtacgacacgaccggtgctcgatttagtatctgatagttgggtttggggggtccaggaggcagaactctgggtgtctcaccatggcctggatccctctcttctccccctcctcactctctgcacaggctctgaggcctcctatgagctgacacagccaccctcggtgtcagtcgtccccaggacagacggccaggatcacctgctctggagatgcattgaccaaacgntatgcttatgtaccagcagagcggcagccctgtgtgtgatgtataaagacactgagagccctgagggactccgtgagccgattctcctggctcgaggtcaaagggacaacggtcaacagttcgggacctagtcaggttggacgtaccgagggacgaggagggaccggaaggccgtaggtacttatttaagttgtaccaaagttacaaacgacgaaccgacctagtttcggttaactttagtcgttaccttacggtaacgttggaaccgtaacgttaaacgggtccttaaaccgtccgtggggttaccacggacccgaacgggccccaaaccccgattcgttacctaaccgttctttaaccccg

SEQ ID NO: 352249 - DNA, 663 bp, Homo sapiens
  misc_feature: GZ8MTXP01BUE1B.52.38.D05.1.454.CMB.2.raw
  modified_base (227)..(227): a, c, t, g, unknown or other
  misc_feature (227)..(227): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgctattcgaccaaacgatatgcttatggtacagcagaacggccgggccaggcccctggtgttggtgatagtaataaagacacgtgacgacggccctacgaggactcccgtgacgccgattctcgtggcctaccgaggtcgagggaacacgggtcacgtagttcggacctatcgaggtcgggacgtacccggagggaccgagggacgggacggacggcttaaggaactttaagtttagttacggtaactaaacgttaccaaaacgtacggaacctaaccgttaagtttacggttaactttaaggttcggtttaccgttaacgggtaacttcgggaacccgttaaccgtaaacgggttacccaacccgggttccggttacgggttaaccaccggaacccgaaaccggaccccgaaacccctcgttaaccgtaaccc

SEQ ID NO: 352250 - DNA, 663 bp, Homo sapiens
  misc_feature: GZ8MTXP01D54Q4.52.38.D05.1.454.CMB.2.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
tcagcgcagtacgacacgaccggtgctcgatttagtatctgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacgccaggancacctgctctgganatgcattgacccaaaccgatatgtcttagttggtaccagacagaacggcccgggccgacggccccgtgtgttggtgtatgtaataaagacactgagacggtccctcgaggactcccgtagacgcgtactttccctcgtgggcctaccgacgggtaccgaaggggaaccgtaaaccgggtaccaacggtacttcgggaccctattacgtaacggtggaaccggtccgagggacgaggaacgggtaacggaacggtcgtacggaacgttatttagttcgtaacgtaacttacaaacgtagacctaaccgtagtttacggttaacctttagtcgtttacgtacgggtaaacctggaccgaaaccgtaaggttccgtaaacccgtccgttcggggccaccggcccgaacggaacccaacccccgtagttctaacccgaactttcccg

SEQ ID NO: 352251 - DNA, 672 bp, Homo sapiens
  misc_feature: GZ8MTXP01DJ4ID.52.38.D05.1.454.CMB.2.raw
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (225)..(227): a, c, t, g, unknown or other
  misc_feature (225)..(227): n is a, c, g, or t
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggactcnctnctgagannnatntacgaacaactntatntattagtacanaganagacgccgcgaccgtcgtgtgtgatatagtaaagaacactgaggacgtcccgtccgaggagtcctcgtagacgtacttcttcgtcggtccgtccgtaacggaggtaacgggaacgaaaccgtacggactaacgttcgtccgaactcgtagtagggtacggaccgacggacggagggaaacgggacgggtaacggcgtaagtaactttaagtttaacgtttaacggggtacttaaactaaaccaaacgaaacgaaccaaccgttaaacttgggttttaacctatttaccgtacgttaccggtaaacgtacgacccggtaacgaaaaccgggttcgtaaccccgttcggttcgggttcgaacccgacccgaaaccgggtccccaaaccccgttactaacgttcccgtaacccg

SEQ ID NO: 352252 - DNA, 603 bp, Homo sapiens
  misc_feature: GZ8MTXP01EHN37.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccccaggacagacggccaggatcacctgctctggagatgcattgaccaaaccgatatgtcttattggtaccagcagaagccggcaggcccctgtgttggtgatgtaataaagacactgagacggccctacgagggactcccgtgagcgtattcctctggctccgaggtacgagggaaccgaaacgggtcactagttcgggcccaagttcaagttggactccgaaggcaggacgggacgaggctagactaagttatcgttaacaatacaacacgactactagttacgttacttagttcgttacgttacgaactaacgaaccgttaaccgtaacgttccgtaccgtccggttacggttccaaccgaacccgaaccgtaaccccaaaccctacgttaccgtaaccgttaaccgttccg

SEQ ID NO: 352253 - DNA, 504 bp, Homo sapiens
  misc_feature: GZ8MTXP01DJI8K.52.38.D05.1.454.CMB.2.raw
  modified_base (239)..(239): a, c, t, g, unknown or other
  misc_feature (239)..(239): n is a, c, g, or t
  modified_base (369)..(369): a, c, t, g, unknown or other
  misc_feature (369)..(369): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (488)..(488): a, c, t, g, unknown or other
  misc_feature (488)..(488): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggcaggcccctgtgttggtgatgtataaagacactgagaggcctcagggactccctgagcgattccctctggctccaggtcagggcaacggtcacattggccancagtgagtccaggcagaggacgnggcngactattattgtcaatcaaacagacaccattggtacttatgtctcggatgcgactaaggcaccgtcttgggttcacgcccaaggccaacccncttcgtcaacgttccc

SEQ ID NO: 352254 - DNA, 603 bp, Homo sapiens
  misc_feature: GZ8MTXP01DF4JO.52.38.D05.1.454.CMB.2.raw
  modified_base (227)..(227): a, c, t, g, unknown or other
  misc_feature (227)..(227): n is a, c, g, or t
  modified_base (306)..(306): a, c, t, g, unknown or other
  misc_feature (306)..(306): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgctattcgaccaaacgatatgtcttattggtaccagcaagaacgccgggccacggcccctgtgttggtgatagtaanaaagacacgtgagacgggccctcgacgggactcccgtggacgtcccgtattcgtcgtcggcctaacccgaggtcgacgggaaccaaacgggtcacgtagttcggcatcgaggtaggacgtccgaggacgagggacgacggagtctagacttagttagttcgactaatacaagaacgacacctaagttcggtaacttagtcgtcgttaacgtaaacgttcgaccgacgtacggtccaaccggttccgagggtaaccacggccccgaacggaccccttaacccctcgttcgttaacccc

SEQ ID NO: 352255 - DNA, 622 bp, Homo sapiens
  misc_feature: GZ8MTXP01EHYM0.52.38.D05.1.454.CMB.2.raw
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctcgtggagatgcattcgaccaaacgatatgtcttatggtaccagcagagccggcaggccctgtgtggngatgtaanaaagcactgagacgccctgagggctccgtgagcgtattctcgtggctccgaaggtcgaagggacaacggtacactagttcggacctatcgaggtggacgtccgaggcgaaggagggacgaggctagaactttaagtttattagggtaactaaactacgaaacgtacgaacctaaccgttaagtttacggttaactttacgttacgttaccgtttaccggtaaacgtcgaccggtaaaccgttaaacggttcccgtaacccggttcggttccgggttaccaaccggaccccgaacggacccccaacccgactttccgttaacccgttaaccccg

SEQ ID NO: 352256 - DNA, 597 bp, Homo sapiens
  misc_feature: GZ8MTXP01DE81R.52.38.D05.1.454.CMB.2.raw
  modified_base (228)..(228): a, c, t, g, unknown or other
  misc_feature (228)..(228): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
tcagcgcagtacgacacgaccggtgctcgatttagtatctgatagttgggtttgggggctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctcgtgganatgcattgaccaaacgatatgtcttatgtacagcagacgccggcacggccctgtgtgnatgtaanaaganactgagacgcctacgaggactccgtgacgcctattctcgtcgcctaaccgaggtcgacgggaacaaaccgggtcaacgtgttcggactatcgtaggtggacgtccgaaggacaagggacggacggagtcgtaggtaacttaagtttgttacgtactaaactacaaacgtaacgactacctaagtttacggttaacttagtcgttacgttaacggaacttcggaccgaaccgtaaggtccttaacccggttcgttcgggaacacgaaccccgaacggaccccaaccctcgttcgtaaccc

SEQ ID NO: 352257 - DNA, 533 bp, Homo sapiens
  misc_feature: GZ8MTXP01D6H2Q.52.38.D05.1.454.CMB.2.raw
  modified_base (497)..(497): a, c, t, g, unknown or other
  misc_feature (497)..(497): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctgagggatccctgacgccgattctctggctccaggtcgagggacaaacggtcacattgggccatcagtggatccaggcagaggcgaaggctgaacttattagttgtacaaatcaaacagacaacctagttggtacttatgtcttaacggaaacttgacgaaccgaaaggttccaaccgttcncgggtcacgcccaaggccccaaaccctcgttcgtcc

SEQ ID NO: 352258 - DNA, 534 bp, Homo sapiens
  misc_feature: GZ8MTXP01B92ZZ.52.38.D05.1.454.CMB.2.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (525)..(525): a, c, t, g, unknown or other
  misc_feature (525)..(525): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgntatgcttatggtacagcagacgccggcacggccctggtgttggtgatgtaataaagacactgagacggccctgagggactcccgtgacgccgattcgtcgtacggctaccgaggtcgagggacaacggtcactagtcggcctatcgagtaggagccgaggacgaggacggacgaggctagactagttagttgtacaatacaaacagacacgtatgtacttatgtcttaacggattcgcacgagtccacgttcgttcgggcacgccaacggcccaacccgtnttcgtaacc

SEQ ID NO: 352259 - DNA, 571 bp, Homo sapiens
  misc_feature: GZ8MTXP01DLOM8.52.38.D05.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (439)..(439): a, c, t, g, unknown or other
  misc_feature (439)..(439): n is a, c, g, or t
  modified_base (554)..(554): a, c, t, g, unknown or other
  misc_feature (554)..(554): n is a, c, g, or t
tcagcgcagtacgacacgaccggtgctcgatttagtatctgatagttgggtttgggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctgganatgcattcgaccaaacgntatgcttatggtaccagcagaagccggcacggccctgtgtggtgatgtataaagacactgagacggccctgagggactccctagagcgtattccctcgtggcctccgaggtacgaacggggaaccaaacgggtcaaccgtattcgggaccctatcgagtgtacgccgaggacaggaggacgagctagactattagttnactaatacaaacagaaccacctagtttacgtaacttatcgttacgttacggaaactgaccgaacgtaacggttccgtaccgtccgttgggccacgaacccgaacggcccaacccnttcgtccaacgttcccg

SEQ ID NO: 352260 - DNA, 547 bp, Homo sapiens
  misc_feature: GZ8MTXP01C59H1.52.38.D05.1.454.CMB.2.raw
  modified_base (217)..(217): a, c, t, g, unknown or other
  misc_feature (217)..(217): n is a, c, g, or t
tcagcgcagtacgacacgaccggtgctcgatttagtatctgatagttgggctgtgggtccaggaggcagaactctcggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgatatgcttattggtacagcagaagccggcaggccctgtgttgtgatgtaataaagacactagagacggccctgagggactccgtgagccgtattctgtcggctacccgaaggtcaagggacaacgggtcaacgtagttcgggaccaagtcaggtcggacgtccgagacgaggaggacgaggctagactattaatggtacaatacaacgtagacactattagtacttactgtctggtaactggacgaacgaacgttccgaaccgttcgttcgggttcaacgacccgaacggccccaacccgactcgttccgtaac

SEQ ID NO: 352261 - DNA, 669 bp, Homo sapiens
  misc_feature: GZ8MTXP01C48N0.52.38.D05.1.454.CMB.2.raw
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
tcagcgcagtacgacacgaccggtgctcgatttagtatctgatagttgggtttggggggtccaggaggcagaactctgggtgtctcaccatggcctggatccctctcttctccccctcctcactctctgcacaggctctgaggcctcctatgagctgacacagccaccctcggtgtcagtcgtccccaggacagacggccaggatcacctgctctggagatgcattgaccaaacgatatgtcttattgtaccagcagacgcggcagccctgtgtgtgntagtanaagacacgtgagacggccacgagggtacnccgtagacgcgtattctccgtggctccgacggtacgaaacgggtaaccaacgggtacacgtaacgtttcgggacctaagtcgagggttggacgtaccgaagggacgaaggaacggggaacggacgggtacttagtaacgttatttagttagtaaccaacgttacaaacgaagtaaccgtaaccttaagtttcggttaactttaagtcggtttacgttaccggtaacgttcggaaccggtaaccgaaacgggttaccgacccggtttaccggtcgggttacccgaccgaccccggaaacgggaccccctaaaccccgttaccgtccggttaccctaacgttcccctttaacccccgg

SEQ ID NO: 352262 - DNA, 745 bp, Homo sapiens
  misc_feature: GZ8MTXP01BP85K.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagtcaccctcggtgtcagtgtccccaggacagacggccaggatcacctgctcgtggagatgcattgaccaaaccgatatgcttattggtaccagcagaagccgggccaggcccctggtgtggtgatgtataaagacactgagacggccctcgaggggtactcccgtgacgcgtattcccctcgtcgggcctccgagggtaccgaacgggggaaccaaaccgggttcaaacgtacgtttcggggacccctagttaccgagggttcggggtaacgttaccccggaggggaccgaaggggaaacggggaacggaggggtacctagggtaaccctttaagtttaagtttccggtacgaaaactttaccaaaacgaaccggaaacctaacccgtaagtttaggggtttaacctttaaacgttcggtttaccgtttacggggaaaccttcggtaacccgttaacccgtaaacggggttcccgaaaccccggtttcccggttacgggggttacccaaccgggtaaccccccgaaaacggggtcccccaaaacccccgtcgttacggttaaccccaacgttttccccg

SEQ ID NO: 352263 - DNA, 671 bp, Homo sapiens
  misc_feature: GZ8MTXP01DHH9Z.52.38.D05.1.454.CMB.2.raw
  modified_base (245)..(245): a, c, t, g, unknown or other
  misc_feature (245)..(245): n is a, c, g, or t
  modified_base (288)..(288): a, c, t, g, unknown or other
  misc_feature (288)..(288): n is a, c, g, or t
tcagcgcagtacgacacgaccggtgctcgatttagtatctgatagttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacaggacggccaaggatcacctgctcgtggagatgcattcgaccaaacgntatgacttatggtaccagcagacgccggcacgccctgtgtggngatagtaataaagacacgtgaacgacggtccctagaagggactcccgtaggacgcgtatttccctcgtcgggtcctacccgaggtaacgaaggggaacctaaacgggtcaacgtaagttcgggacctaagtcgaggttggacgtccgaggacgaggaaggacgtaggtactagaacttattattcgtaacaaactacaaaacacggtaaccaacctagtttaggttaaaccttttaagtcgggtttaccttaacgggtaacctaagggaaccgttaaaccgtaaacggttccgtaaaccccggttcggttacggggttaccaaaccggaaccccgaaaacggccccaaaccccggtacttacgtaacccttaacgtttccccg

SEQ ID NO: 352264 - DNA, 563 bp, Homo sapiens
  misc_feature: GZ8MTXP01A245H.52.38.D05.1.454.CMB.2.raw
  modified_base (238)..(238): a, c, t, g, unknown or other
  misc_feature (238)..(238): n is a, c, g, or t
tcagcgcagtacgacacgaccggtgctcgatttagtatctgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtacagcagaagcggcaggccctgtgtggtgatgtataaagacactgagacggccctcgagggactcccctgacgcgattcctctggctccgaggtcaggggaacaaacgggtcaacgattcggccatcgagtggagtccaggcagaggacgaggctagactagttattgtacgaaatacaaacagaacacctattggttaacttatgttacctttacgggaactggcgacccgtaaaggttccgtaaccggtaacgttcggggttacacggccccaaacggcccaaacccacgttcgtaacccgaacgttcccg

SEQ ID NO: 352265 - DNA, 636 bp, Homo sapiens
  misc_feature: GZ8MTXP01CJSOB.52.38.D05.1.454.CMB.2.raw
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
tcagcgcagtacgacacgaccggtgctcgatttagtatctgatagttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcacctgctntgganatgcattcgaccaaacgatatgtacttattggtaccagacagaagccgggccaggcccctggtgttggtgatagtaataaagacactaggacgaggccctagaagggctcccgtgacggctattcccgtcgtcggctacgaggtacgaacgggaacgaacgggtacacgtagttcgggaccattacaggttaggacgtccgaggacaggaaggacgagggtctagaacttattagttcgtactaactacaaacacgaactaaccgtagtttacggttaacctttaatcgtttacgtacggtaacttcggacgaaaccgtaaacgggttccgtaacccgtcgttcggggttcaccgaacccgtaaacggaaccccaaacccgtaccgttcgtaaccgttaacccgttttcccg

SEQ ID NO: 352266 - DNA, 635 bp, Homo sapiens
  misc_feature: GZ8MTXP01DPDZX.52.38.D05.1.454.CMB.2.raw
  modified_base (219)..(219): a, c, t, g, unknown or other
  misc_feature (219)..(219): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattcgaccaaacgatatgcttattggtaccagcagaagccggcacggccctgtgttggtgatgtaataaagacacgtgagacggccctcgagggactcccgtggagcgtacttcctcgtggcctccgaagggttccgaaggggaaccaaacgggtccaacgtacgttcgggaccctatacgaggtggacgtccgaggacgaaggaaggacggaggcgtagacttaattagttaggtactaaatcaaacagaaactaccgtagtttacggtactttaagtcgttccgttacggtaaacttcggaccgtaaaccgaaacggttacccgtacccggttccgttcggggttaccaaccggacccgaaaccgggacccctaaacccccgttacgttaaccgttaaccgttaaccccg

SEQ ID NO: 352267 - DNA, 570 bp, Homo sapiens
  misc_feature: GZ8MTXP01AKO4L.52.38.D05.1.454.CMB.2.raw
  modified_base (235)..(235): a, c, t, g, unknown or other
  misc_feature (235)..(235): n is a, c, g, or t
  modified_base (277)..(277): a, c, t, g, unknown or other
  misc_feature (277)..(277): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagcgcagtacgacacgaccggtgctcgatttagtatctgatagttgggtttggggggtccaggaggcagaactctgggtgtctcaccatggcctggatccctctcttctcccctcctcactctctgcacaggctctgaggcctcctatgagctgacacagccaccctcggtgtcagtgtccccaggacagacggccaggatcacctgctctggagatgcattgaccaaaccgntatgcttatggtaccagcagaagccggcaggccctgtgtggngatgataaagacactgagacggccctgagggactccgtgacgcgattctctggctcgaggtcaagggacaacggtcactgttcggccatcaagtggtacgccgaggcaggaggacggaggctagacttattatgtanaagtcaanagactacctagttaggtactttaagtcgttcgttacggaaacttcggaaccgaaccgaggtacccgaacccggttccgttcggggaccacggaccccgaacggccccaaacccgtctcggttaccttaaccgttttccggttcccccg

SEQ ID NO: 352268 - DNA, 553 bp, Homo sapiens
  misc_feature: GZ8MTXP01AH9JO.52.38.D05.1.454.CMB.2.raw
  modified_base (181)..(181): a, c, t, g, unknown or other
  misc_feature (181)..(181): n is a, c, g, or t
  modified_base (241)..(241): a, c, t, g, unknown or other
  misc_feature (241)..(241): n is a, c, g, or t
  modified_base (287)..(287): a, c, t, g, unknown or other
  misc_feature (287)..(287): n is a, c, g, or t
  modified_base (517)..(517): a, c, t, g, unknown or other
  misc_feature (517)..(517): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtntcagtgtccccaggacagacggccaggatcacctgctctggagatgcattgaccaaacgntatgcttatggtacagcagaacgccgggccaggcccctgtgttggngatgtaataaagactactgagacggccctacgagggactccctggaacgccgtattctcgtggctacccgagggtcagggaccaaacgggttcactattcggccatcgagtggactcgagcagaggtacgaggctgactatagtcgtacaatacaaacagacaacctagttcggtacttaagtcgtctttaacgggaacttgaccgaacgtaaacgggtcaccgttccgngggtccacgcccaacggccccaaaccctcgcgtccc

SEQ ID NO: 352269 - DNA, 610 bp, Homo sapiens
  misc_feature: GZ8MTXP01BVALW.52.38.D05.1.454.CMB.2.raw
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtggagatgctattcgaccaaacgattatgtcttagttggtaccagcagaacgccggcacggcccctgtgtggtgatgtataaagacatgagacggccctagagggactcccgagacgccgtattcgtcgtcggccttaccgagggtcgaggggaaccaacgggtcaacgtagttcggacccagtccgaggttcggacgtacccgaagggaccgaagggaagggaccggaggccgtagaactttattagttcgtactaaactacaaacacgaacactaagtttcgtaacttatcgttacgtaacggaacttggacgaaccgtaaggtccaccgttccgttacggtaaccacgaacccgaaccggacccaaccccgtaacgttcgtaaccc

SEQ ID NO: 352270 - DNA, 662 bp, Homo sapiens
  misc_feature: GZ8MTXP01C6V9G.52.38.D05.1.454.CMB.2.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (612)..(612): a, c, t, g, unknown or other
  misc_feature (612)..(612): n is a, c, g, or t
tcagcgcagtacgacacgaccggtgctcgatttagtatctgatagttgggtttggggggtccaggaggcagaactctgggtgtctcaccatggcctggatccctctcttcctcccctctcactctctgcacaggctctgaggcctcctatgagctgacacagccaccctcggtgtcagtcgtccccaggacaggacggccaggatcacctgctcgtggagatgcattgaccaaacgntatgcttatgtaccagnagaagccggcacggccctgtgttggtgatgtaataaagacacgtgagacggccctgagggactcccgtagacgtcgtattccgtccgtcggacctccgaaggtccgaaacggggtaacctaaccggggttccaacgtaacgtttcggggacccctagttccgaggttacgggacgtacccgaagggccaagggaacggggaacgaggggtaccttaggtaaccttaaagtttagttacgttacctaaagttacccaaaacgaacgtaaaccaaccgttagtttacggttaacctttaagtcgttaccgttacggaacttcggaacgtacgaaacggtccttaacgtccgtgggttacncggaccccaacggacccaacccgtacgtcttcctaacgttccgttccccg

SEQ ID NO: 352271 - DNA, 754 bp, Homo sapiens
  misc_feature: GZ8MTXP01DVE19.52.38.D05.1.454.CMB.2.raw
  modified_base (249)..(249): a, c, t, g, unknown or other
  misc_feature (249)..(249): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatccacctgctcgtggagatgctattcgaccaaaaccgtntatgtacttagtacgtacagacgaaggaacggcccgggaccgaccggtccccgttggttggttggtagtagttagtaaagtaaacgacgtaacgtaggacggtaccggtacccgtacggtacggtacctcccgtaggacgtacccgtacttcgtcgtcgtccgtaccgaggtcgacggaaccgtaaacgtacacgtacgtacgacctagtacgtaggtacggacgtaccgaagggtacgaagggaacgggaacggtacgggtacgttacgttaactttaagtttaacgttaacgttaactaaacgtaaccgaaaccgtaacgtaacccgttaaccgttaaagttttacggttaaactttaggttaccggtttaccgttaaccgggtaaccgttacgggaacccgttaaaccgtaccggttacccgttacccggttccggttaccgggtaacccaacccggaaccccgaaccggtacccccgttaaaccctcccgttaacgtaacc

SEQ ID NO: 352272 - DNA, 752 bp, Homo sapiens
  misc_feature: GZ8MTXP01DJ0PN.52.38.D05.1.454.CMB.2.raw
  modified_base (175)..(175): a, c, t, g, unknown or other
  misc_feature (175)..(175): n is a, c, g, or t
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (291)..(291): a, c, t, g, unknown or other
  misc_feature (291)..(291): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgacggcctcctatgagctgacacagccaccctcggtntcagtcgtccccaggacagacggccaggatcacctgctctgganatgcattcgaccaaacgntatcgactttagtggtaccagcaaggaacggccggacacggccctgtggtggtnatagtaataaagacatggagacgccctacgacggtctcccgtagacgtcgtacttccgtacgtcggctacccggtaaacggtacgaacggggaacctaaacgggtctaacgtagttacgggctaagttacgaaggttcgggaacgtacccgaagggtacgaaacgggaacgggaacggtacgggtaccgttaaggtaaaccgtttaagtttacgtttacggggtaacgtaaaactttaccgaaaacgtaaccggtaacccttaaccggttaagttttacggggtttaaaccctttagttaccggttaccgttaaccggtaaacgttcggacccggttaaaccgttaccgggttaacccgtacccggttacccggttacgggttaacccgtaacccggtacccccgaaaaccggggtacccccctaaaaccccttcgggttaacccgttccttaacccccgg

SEQ ID NO: 352273 - DNA, 633 bp, Homo sapiens
  misc_feature: GZ8MTXP01AM5NM.52.38.D05.1.454.CMB.2.raw
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccacggcccctgtgttggtgatgtaataaagacactgagacggccctagagggactcccgtgacgccgtattctcgtcggctccgagggtcaggggaaccaacgggtcaactacgttcggacctaagtcaggttagggacgtccgaggacgaggaacggaccggaaggctaggaacttagttattaggtactaaataccaaaacacgaaccaaccctaagtttacgggttaacctttagttacgttccgttaacgggtaaaccttcggaccgttaaaccgtaaacgggtccttaaccccggttcgttacgggggtcccgacgaaccccgaacggaccccaaaccccgtaacgttcgtaaccc

SEQ ID NO: 352274 - DNA, 666 bp, Homo sapiens
  misc_feature: GZ8MTXP01DDC7S.52.38.D05.1.454.CMB.2.raw
  modified_base (219)..(219): a, c, t, g, unknown or other
  misc_feature (219)..(219): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctgganatgcattcgaccaaacgatatgcttattcggtacagcagaacgccggcacggccctgtgttggtgatagtaataaagacacgtgagacggccctacgagggtactcccgtaggacgtcgtactttccgtcgtcggtcctaccggtaaagggttaccgaacgggggtaacctaaaccggggttcaaacgtacgttcggggacctaacgtacgaaggtgggacgtaccgaagggacgaaggaagggaccgagggacttaggaaacttagtttagttaacgggtactaaataaccaaactaagaacctacctaagtttacggtactttaattcgttacgtttaacgggaaacttcggaccgtaaaccaaacggggtcctaaccggttccgttcggggttaccaaccggacccgaaacggtccccaaacccgttcgtcgttccgtaacccg

SEQ ID NO: 352275 - DNA, 629 bp, Homo sapiens
  misc_feature: GZ8MTXP01EN57S.52.38.D05.1.454.CMB.2.raw
  modified_base (219)..(219): a, c, t, g, unknown or other
  misc_feature (219)..(219): n is a, c, g, or t
  modified_base (281)..(281): a, c, t, g, unknown or other
  misc_feature (281)..(281): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctttgcacaggctctgaggcctcctatgagctgacacagccaccctcggtgtcagtcgtccccaggacaggacggccaggatcacctgctntggagatgcattgaccaaacgatatgctttatggtaccagcagagcggcagccctgtgtggnatgaataaagacatgagacggccctcgagggacttcccgtagacgcgtacttctccgtggtcctccggacgggtccggaaacggggaaaccgtaaccggggtactaacgtaagtttccggggaccctaagttcgagggttgggacgtaccgagggacgaggaagggtaccggaagggtctggtaacttagttacttagactaagtacaacacacacctagttggtacttatcgtcgttacggaactggaacctaacgaacgggtcttaacccggttcgtacggggttccacggacccgaaacgggcccctaaaccccgtacgtcgttaccctaaccgttccttccccg

SEQ ID NO: 352276 - DNA, 541 bp, Homo sapiens
  misc_feature: GZ8MTXP01ACBDU.52.38.D05.1.454.CMB.2.raw
  modified_base (241)..(241): a, c, t, g, unknown or other
  misc_feature (241)..(241): n is a, c, g, or t
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggcaggcccctgtgttggtgatgtataaagacactgagaggccctcgagggactccctgagccgattctcgtggctccaggtcgagggacaacggtcacattcggcctagtcgagtggacgtccgaggacgaggaggacgaggactggaacttattagttgtactaactacaaacgagaaccacctaagttggtaaccttatgtcttaacggaacttgacgacgagtccacgttccgngggtccncgcccgaacggcccacccaattcgtaacc

SEQ ID NO: 352277 - DNA, 602 bp, Homo sapiens
  misc_feature: GZ8MTXP01C8LSB.52.38.D05.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
  modified_base (448)..(448): a, c, t, g, unknown or other
  misc_feature (448)..(448): n is a, c, g, or t
tcagcgcagtacgacacgaccggtgctcgatttagtatctgatagttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaaggatcactgctcgtgganatgacattcgaccaaacgtntatgtacttagtggtaccagcaaggacgccgggcacggccctggtgttggntagtagtaaataaacgactacgtgacggacgccgtacgagggtactccgtaggacgcgtacttccgtctcggcctacgaggtaacgacgggaactacgggtacacgtacgttcggaccatcgagtagacgacgaggcgaggaacggtacggngtactagtattattatacgtaacaactaacaacgacactacgtagttacgttaactgtcgtacgtacgacgtcgtacgttacgtacgttccgtacggtcgttacggaccaccggaacccgtaccgaacccaacctcttccgtccttccgtaacc

SEQ ID NO: 352278 - DNA, 642 bp, Homo sapiens
  misc_feature: GZ8MTXP01AJ8C5.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgcttattggtaccagcagaagccggccacggcccctgtgttggtgatgtaataaagacactgagacggccctacgagggactcccgtagacgcgtatttccctcgtggctccgaggtaccgaagggaacaaacgggtcaacgagttcgggaccatcaggtggacgtcgagggcgaggaagggacgaggctgtactattattgtacgaaatcaaacgtacgaaccaaccgtagtttcgggttaactttagtcgttacgttaccgggaacttcggaccgaaccgtaaacgggttcccgaaacccggttccgttacgggggttccaaccggaacccccgaaacgggaacccccctaaaaccccccgacggtttacggtaaccccttaacccgtttcccccg

SEQ ID NO: 352279 - DNA, 651 bp, Homo sapiens
  misc_feature: GZ8MTXP01B9TCO.52.38.D05.1.454.CMB.2.raw
  modified_base (238)..(238): a, c, t, g, unknown or other
  misc_feature (238)..(238): n is a, c, g, or t
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcagttcgaccaaacgntatgcttatgacagcagacgcggcagccctgtgtgnatagtaanaagcacgtagacgacggccctagagggtactccgtgacgcgtacttcgtcgtggtcctcgaagggtcgaaggggtaccaacgggttcaacgtacgttcggacctagtcgaggtcggacgtccgaaggacgaaggacggacggacggtactacgtaacgttagtttaagttacgggtactaaacgttcaaacgaacgtaacctaaccgtagtttacgggtactttaacgtcgttaccgttacggtaacgtcgttaccggtaaaccgttaacgggttacccgacccggttacggttccggggactaacccgggtaccccgaaaccgggacccccgtaaaccccttacgttcccggttaaccttaaccccgg

SEQ ID NO: 352280 - DNA, 629 bp, Homo sapiens
  misc_feature: GZ8MTXP01EV5VD.52.38.D05.1.454.CMB.2.raw
  modified_base (228)..(228): a, c, t, g, unknown or other
  misc_feature (228)..(228): n is a, c, g, or t
  modified_base (287)..(287): a, c, t, g, unknown or other
  misc_feature (287)..(287): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctcgtgganatgcattcgaccaaacgatatgcttatgacagcagacgccggcacggccctgtgttggnatagtaataagacacgtgagacggccctcgagggtactccgagacgtccgtacttcgtacgtcggtaccctacccggaagggtccgaacggggtaaccgtaaccgggtactaacgtacgttacgggaccctagtacgaggtcggacgtccgagggacgagggacgggacgaggcgtagtaacgttaatttagtcgttaacaagtacaaacaacgacctaaccgtagtttacggtactttagtcgttacgttaacgggaacttcggaccgttaaccgtaacggtccgacccgttcgttacgggtaacaccgaacccgaacggccccaacctcgttcgtaaccg

SEQ ID NO: 352281 - DNA, 830 bp, Homo sapiens
  misc_feature: GZ8MTXP01BV6P0.52.38.D05.1.454.CMB.2.raw
  modified_base (312)..(312): a, c, t, g, unknown or other
  misc_feature (312)..(312): n is a, c, g, or t
tcagcgcagtacgacacgaccggtgctcgatttagtatctgatagttgggtttgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctcgtaggagatgactattcgacccaaacgattatcgtacttagttggtaaccagacgaaggaacggcccgggccacggcccctggtggttggtnattaggtaaataaagacacgtacggaaggacgggcccctacggaaggggtacctcccgtaggaacgtccggtactttcccgtccgtacgggcccgtaccggacgggttaaaccgaaacgggggtaaccctaaaccggggtccaaacggttacgtttaccgggaccctaagttacccgtaagggttgggtaaccgtacccgggaagggaccggaaaggggaaccgggaaccggtaaggggtaccttaaggttaaactttaagtttaacgtttacgggttaaccttaaaacgttaccgaaaaccgaaaccggtaaccctaaacccgttaaggttttaaccgggtttaaaccttttaggttaccggtttaaccggtttaccggaaaccgttaacggaacccggttaaacgtaaaccgggttcccgtaaacccgggttccgttacggggttcccaacccggtaaccccggaaccggaaccccaaccccgttaccgttacgtaacccttaacccgtttccccg

SEQ ID NO: 352282 - DNA, 616 bp, Homo sapiens
  misc_feature: GZ8MTXP01BLXC2.52.38.D05.1.454.CMB.2.raw
  modified_base (232)..(232): a, c, t, g, unknown or other
  misc_feature (232)..(232): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacactgccacctggtgtcagtcgtccccaggacagacggccaggatcacctgctctggagatgcattgccaaacgntatgcttatggtacagcagaagccggcacgccctgtcgttggngatgtanaagcactgagacgcccctgacgggatcccgtgacgcgtacttcctcgtcggctcccaaagggttcgaagggaccaaacgggtcacgtaagttcgggaccataccgaggtcggtacgtcccgaaggcgaaggacgggacggtacgggactagggtaccttaagtttacttcggggtaactaaactaccaaacgaggtaacctaccgtaagtttacggttaacttagtcgttacgttacgggaaacttcggacgtaccttaaagggtcctaccgttcgcgggttccaacgtacccgaaacggccccgaaaaccccttgtaaccgttcgttaacccg

SEQ ID NO: 352283 - DNA, 614 bp, Homo sapiens
  misc_feature: GZ8MTXP01AH695.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcagttcgacccaaaaccgtattatgtacttagttcggtaaccagcaaggaacggcccgggaccacggccccgttggtcgtttggtgtattagtaaataaagacacgtgaaggcggccctagagggactcccgtggacgcgtattccgtcgtggcctccgaggtaccgaagggtaacacggtcactagttcggcatcaggtgacgtcgaggcgaggaggacgagtctagacttattattgcgtagtacagtacgagacgagcgtaagtcggacttaacgttagttggtcgttacggttcggggacgggaacggtaaacccgtaacgttaccggttacccgttacgtaacgggaccaacgcccgaacggccctcccggcccccgttcgg

SEQ ID NO: 352284 - DNA, 690 bp, Homo sapiens
  misc_feature: GZ8MTXP01AMF7J.52.38.D05.1.454.CMB.2.raw
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctcgtggagatgctattcgaccaaacgatatgtcttagtggtaccagcagaacgccggcacggccctgtgtggngatgtanaaagacacgtgagacggccctagagggactcccgtagacgcgtactttcccgcgtcggccctaccggaggtaaccgaacggggaacctaaccgggtcaacgtacgtttacgggaccctagtaccgtaggttacggggacgtcccgaagggaccgaaagggaacggggaacccgggtagggtacccgttaagggaaaccttttaagtttaagtttacggttaacaaacgtttaaccaaacgaacggtaacctaacccgtagtttacggttactttaagttcgttacgttaccgaattcgaccgttaaccgtacggttccgtaaccggtccgttaggggttcccacggccccgaacggaaccccaaacccgtcgttactccgttaacgtttcccg

SEQ ID NO: 352285 - DNA, 622 bp, Homo sapiens
  misc_feature: GZ8MTXP01A475C.52.38.D05.1.454.CMB.2.raw
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctggagatgcagttcgaccgaaccgatatgtcttatggtaccagcagaagccggcaggcccctgtgttggtgatgtataaagacactgagaggccctacgagggatcacgtgacggctattctctggctccgaaggtcacgggacaacgggtcactagttcggacagtcaggtggacgtacccgagggccgaaggacggacggaggaccgtaggtaaccttaaggttatttaggtacctaaattaccaaacgaagaaccctaaacgtacgtttaacgggttacctttaagtcgtttaaccgttacggggaaacttcgggacgaaaccgtaacggttaccgttacccggttccgtcggggtaccaacggccccgaacgggaccccaaaccccgttcgttaacccg

SEQ ID NO: 352286 - DNA, 763 bp, Homo sapiens
  misc_feature: GZ8MTXP01ADHHD.52.38.D05.1.454.CMB.2.raw
  modified_base (223)..(223): a, c, t, g, unknown or other
  misc_feature (223)..(223): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaaccgatatgcttattggtaccagcagaacgccggcacggccctgtgttggtgatgtaataaagacactggagacgggtcccctagaacggggtactccccgttaggacgtcgtaactttcccgtccgtcgggtaccctacccggaaggggttaacccgaaacgggggtaaccgtaaaccggggttaccaaccggtaaacgtttcggggacccctaagttacccgaagggttagggaaccgttaccccgaaggggaccgtaaagggaacgggtaccgaaaggggtccttaggtaaccgttaatttaaccgttagtacgtaaacttaccaaacaacggtaaccaaccctttagttacgggtttaaaccttaggttcgttacccgtttacggggaaacttcggacccggaaaccgttaaacggggttcctaaacccgggttccgtttagggggaccccaacggcccccccgaaaagggaacccccttaaaaccccccgtacggttccgtaaccccgttaacccgttcccg

SEQ ID NO: 352287 - DNA, 664 bp, Homo sapiens
  misc_feature: GZ8MTXP01BKHSA.52.38.D05.1.454.CMB.2.raw
  modified_base (240)..(240): a, c, t, g, unknown or other
  misc_feature (240)..(240): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattgaccaaacgtntatgtacttagttcggtaccagcaagaacggccggccacggccctagtgttggtgtatagtaataaagcacgtggacgacggtccctagagggtactcccgtgaagtccgtagttcccgtcgtcggctaccgaggtaccgaacgggtaacgaacgggtcaacgtacgttcgggacctaagtcgaggtcgacgtcgaggacaggaaggcgaaggtctagaattattagtacgtacaaactacgaaacgacgtaacctaaccgttagttaacggttaacctttagtcgggttaccgttaaccggaacgttcgaaccggttaacccgtaaacgggttcccttaaacccggtccgttacggggttccaaccggtaaccccgaacgggaaccccttaaccccgacgttacgtcccttaacgtttccccg

SEQ ID NO: 352288 - DNA, 576 bp, Homo sapiens
  misc_feature: GZ8MTXP01ER5IR.52.38.D05.1.454.CMB.2.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (285)..(285): a, c, t, g, unknown or other
  misc_feature (285)..(285): n is a, c, g, or t
  modified_base (433)..(433): a, c, t, g, unknown or other
  misc_feature (433)..(433): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgccagtcgtccccaggacagacggccaggatcacctgctctgganatgcattcgaccaaacgntatgtcttatgtacagcagagccggcacggccctgtgtggngatgtataagacatgagacgcctagaggactccgtgagccgtattcgtcgtgccgtccgaggtcgagggacgaacggtcacgtagtcgggacctatcgaaggtggacgtccgaggacgagacggacgaggctagactattagtcgtanaatcaaacgagaccaactagttaggtactttaagtcgtcgttaacggtaaacgttcgcttaaccgaaacggtccgaaccggttccgttcggggtaaccaccggtaaccccgaaccggaccccaacccgtccgttccgtaaccc

SEQ ID NO: 352289 - DNA, 638 bp, Homo sapiens
  misc_feature: GZ8MTXP01BIOWU.52.38.D05.1.454.CMB.2.raw
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaaggacagacggccaggactcacctgctcgtggagatgcattcgaccaaaccgntatgtcttatggtaccagcagacgccggcacggccctgtgtggtgatgtaataaacganacgtagaggacggccctgacgggtctcccgtgacgcgtattccgtcgtggcctccgaggtcgaacgggaacgtacgggtacactagttcggactatcgagtgacggtccgagggcctaaggacgggtacgagctaggtactaagtttattcggtactaaattacgaaacctacgaactaaccgtagtttacggtaaactttgtcgttaccgttacggaaacttcggaacggttaaacccgaaaggttcccgacccggttccgttacgggttccgacccgaaccccgaaaccgggccccaaaaccccgttcgaacgtcccgttaacccttcccg

SEQ ID NO: 352290 - DNA, 691 bp, Homo sapiens
  misc_feature: GZ8MTXP01DOJG3.52.38.D05.1.454.CMB.2.raw
  modified_base (302)..(302): a, c, t, g, unknown or other
  misc_feature (302)..(302): n is a, c, g, or t
  modified_base (349)..(349): a, c, t, g, unknown or other
  misc_feature (349)..(349): n is a, c, g, or t
tcagcgcagtacgacacgaccggtgctcgatttagtatctgatagttgggtttgggggctgtgggtccaggaggcagaactctgggtgtctcaccatggcctggatccctctacttcctccccctcctcactctctgcacaggctctgaggcctcctatgagctgacacagccaccctggtgtcagtcgtccccaggacagacgccaggatcacctgctcgtggagatgctagttcgaccaaacgatatgtacttagtggtaccagacagaacggcccgggacacggcccctggtgttggtnatagtaataaacgacacgtgagaccggccctaggacggtactcccgngacgtccgtacttcgtacgtcggccctaaccggagggtaacggaacgggaaccgtaaaccgggtcacgtagttacggacctagtcgaggtggacgtccgagggacaagggaggacggaggactaggtaactttaagttagtacgtacaactacaaacgacgtactacgttaagtttacggttaacttagttacggttccgttaacgggtaacttacgggtaacccggttaaccggtaaacgggtcccgttaaacccgggttcccgggttacgggtaacccgtaacccggaaccccgaaaccggggtacccccttaaacccggtaaccttccggtttaacccc

SEQ ID NO: 352291 - DNA, 695 bp, Homo sapiens
  misc_feature: GZ8MTXP01D7YAW.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggactcacctgctcgtggagatgcattcgacccaaaaccgtatatcgtacttagtcggtacagacaaggaacggcccgggaccgaccggccccttggttgttggtagtagttagtaaataaagacacgtagagacggccctaggacggactcccgtagacgcgtacttccgtcgtcggcctccgtacggtaacgaacgggaacgtaacggtcaaccgtagttcggactagtcgaggttcggacgtaccgaagggcgaagggaacgggacgacgggtactagtaaccgttatttaacgttcgtaacgtaaacttacaaacgacgtaaccgtaaccgttagttacggtttaacctttgttcgttaccgttaacggaacgttaacgacccgttaacgtaaaccgggttccgtaacccggttcggttacggttccacccggaacccgaaaccggtccccgaaaccctcgttacgtcccgttaacgtttccccg

SEQ ID NO: 352292 - DNA, 625 bp, Homo sapiens
  misc_feature: GZ8MTXP01AHLDK.52.38.D05.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggcaggatcactgctcgtgganatgctattcgaccaaacgntatgtacttatgacagcaagacgccggcacggtccctgtgttggngatagtaataaagcagtggagacggccctagagggtacctccgtgacgtccgtacttcgtacgtcggcctaaccgaggtccgaaagggtaccgaacggtcacgtagttcggacccatcgaggtcggacgtccgaagggacgaagggacggacgacggtctaacggtactttaagttacgggttataccgtaaactaaccaaacgacgtaacctaccgtagtttacggtacttaagttcgttaccgtaacggaacttggacccgaacgtaacggtccacccgttcgttaccgggtaacaccggaacccgaaacggccccaacccgtgttccgtaaccc

SEQ ID NO: 352293 - DNA, 604 bp, Homo sapiens
  misc_feature: GZ8MTXP01D8WAT.52.38.D05.1.454.CMB.2.raw
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (510)..(510): a, c, t, g, unknown or other
  misc_feature (510)..(510): n is a, c, g, or t
tcagcgcagtacgacacgaccggtgctcgatttagtatctgatagttgggtttgggggctgtgggtccaggaggcagaactctgggtgtctcaccatggcctggatccctctacttcctccccctcctcactctctgcacaggctctgaggccctcctatgagctgacacagcccacccgtggtgtcaggtcgtccccaggacaggacggccaggatccacctgctcgtagganatgcattcgaccaaacgntatgtcttattggaccagnagagccggcacggccctgtgtggtgatgtaanaagacagtgagacgcctagaggtactccngacgtccgtattctgtggcctaaccgagggtccgaaggggtaaccaaccggtcaacgtgttcgggaacccagttcaaggtgggactccggaaggccgaaggagggaccggagggtactaggtaactttactttaattcgtacaaacttccaaataacgacaccgtagtttgtaacttntcggtcgttaacgacgttacgcttaccgtaaacgtccgacgtttcccgcgggtaacaccggaacccgtaacgccccgttaaacctcgttcgtcc

SEQ ID NO: 352294 - DNA, 761 bp, Homo sapiens
  misc_feature: GZ8MTXP01BGWZR.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacacgcccaccctggtgtcagtcgtccccaggacaggacggccaggactcacctgctcgtggagatgctattcgaccaaacgtatatcgtacttagttcggtacagcaagaacggccgggccgacggtcccgtggttcgttggtgtagtagtaaagtaaacgacacgtaggagacggtcccgtacgacgggtactcccgtaggacgtacgtactttcccgtcgttcggccgtaccgacgggtaacgaacggggtaaccaaaccgggtacaacgtaacgttcggctacgttacgagggtcggtacgtacccggaagggccgaaggggaaacgggtacggaacggggtacttaccggtaactttaaagtttaacgttacggtaacgtaaacgttaacctaaaccgaacgtaaacctaaccgttaagtttacggtttaaacctttagttcgttacgtttaaccgggtatccggtaacgttaacccggtaaacggttcccgtaaacccgggttcggttaccggggttaccaacccggtaaccccgaaaccgggtaacccccaaacccgtaccgttaccggtaaccttaacccggtttccccg

SEQ ID NO: 352295 - DNA, 613 bp, Homo sapiens
  misc_feature: GZ8MTXP01ERG27.52.38.D05.1.454.CMB.2.raw
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
  modified_base (426)..(426): a, c, t, g, unknown or other
  misc_feature (426)..(426): n is a, c, g, or t
tcagcgcagtacgacacgaccggtgctcgatttagtatctgatagttgggtttgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggacggccaggatcacctgctctggagatgcattcgaccaaaaccgatatgtcttattggtaccagcagaagccgggcaggccctgtgtggtnatgtaataaagacactggagaggcccctacaaggggtactcccctgagcgtatttccncgtggcctcgaggtaccaaggggaaccaaacgggtcaactagtttagggcccaaatccgagtggagttacccaggnaaggaaggacgagggtacctaagtattattatagtaacaactaacaaacaacgaactaactagttagttaacttacgttagttacgtacgtaacgtaacgtacgaaccgtaacgttaccgtaccgtccgttcggttcgaccgaacccgaacccgaacccgaacccaccgttacgtccgttccgtccg

SEQ ID NO: 352296 - DNA, 530 bp, Homo sapiens
  misc_feature: GZ8MTXP02F1QOR.52.38.D05.1.454.CMB.2.raw
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgtggtgatgtataaagacactgagaggccctcgagggactccctgagcccgattctctggctccgaggtcagggacaaacggtcacattggccatcagtgagtcaggcagaggacgaggctgactattagttgtacaatcaaacagaacacctattaggtacttaatcgtcttacggaactgacgaaccgaaaggtccaaccgtccgtagggtccacggacccaaacggcccaaacccgactcgtaccc

SEQ ID NO: 352297 - DNA, 512 bp, Homo sapiens
  misc_feature: GZ8MTXP02G0RLW.52.38.D05.1.454.CMB.2.raw
  modified_base (244)..(244): a, c, t, g, unknown or other
  misc_feature (244)..(244): n is a, c, g, or t
  modified_base (287)..(287): a, c, t, g, unknown or other
  misc_feature (287)..(287): n is a, c, g, or t
  modified_base (399)..(399): a, c, t, g, unknown or other
  misc_feature (399)..(399): n is a, c, g, or t
  modified_base (421)..(421): a, c, t, g, unknown or other
  misc_feature (421)..(421): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaccgntatgcttatggaccagcagaagccggccaggcccctgtgtggngatgtaataaagacactgagacggccctgagggactcctgagccgtattctctggctccgaggtcagggacaacggtcacattcgccatcagtgagtcagcagagacgagcngactatattgtacaatacaaanagacacctaattggtacttagtgtacttacggaactgacgacgaaacggtcaccgtcctgggcacgacccaacggcccaacccactcgacc

SEQ ID NO: 352298 - DNA, 537 bp, Homo sapiens
  misc_feature: GZ8MTXP02I91NM.52.38.D05.1.454.CMB.2.raw
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
tcagcgcagtacgacacgaccggtgctcgatttagtatctgatagttgggtttggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggcaggcccctgtgttggtgatgtataaagacactgagaggccctnagggatccctgagccgattcctntggctccgaggtcagggacaaacggtcacattggccatcagtggagtccagggcagagggacgagggctgacttattattgtnaatcaaacaanacactattagtattagtgttacgttacggaactcgaccgaaacgtaacggtcctaccggtccgtacggaaccgaacgacccgaacgaccccaaaccctacgtacgtacc

SEQ ID NO: 352299 - DNA, 530 bp, Homo sapiens
  misc_feature: GZ8MTXP02IFK2F.52.38.D05.1.454.CMB.2.raw
  modified_base (239)..(239): a, c, t, g, unknown or other
  misc_feature (239)..(239): n is a, c, g, or t
  modified_base (336)..(336): a, c, t, g, unknown or other
  misc_feature (336)..(336): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggcaggcccctgtgttggtgatgtataaagacactgagacggccctgagggtactcccgtgagcgattccnctggctcgagtcgagggtacaaacgggtcaactagttcggacctagtacgaagtggaacgtcgaggcaggagacgtgctgactattatgtanaatcaangacactagtcgtatatgtctacggaactgacgaacaacggtcaccgtcgtcggtacacgcccgaacggacccaaccctactcgtaccacttcccg

SEQ ID NO: 352300 - DNA, 497 bp, Homo sapiens
  misc_feature: GZ8MTXP02FUK5W.52.38.D05.1.454.CMB.2.raw
  modified_base (232)..(232): a, c, t, g, unknown or other
  misc_feature (232)..(232): n is a, c, g, or t
  modified_base (401)..(401): a, c, t, g, unknown or other
  misc_feature (401)..(401): n is a, c, g, or t
tcagcgcagtacgacacgaccggtgctcgatttagtatctgatagttgggtttgggggtccaggaggcagaactctgggtgtctcaccatggcctggatccctctcttctcccctcctcactctctgcacaggctctgaggcctcctatgagctgacacagccaccctcggtgtcagtgtccccaggacagacggccaggatcacctgctctggagatgcattgccaaacgntatgcttatggtacagcagagcggcaggccctgtgtggtgatgtataaagacactgagaggccctcagggatcccgtgagcgattctctggctcaggtcagggacacggtcacattggccatcagtggagtccaggcagaggacgaggctgactatattgtcaatcaanagacaccattggtacttatgtcttacggaactgacgaccaaaggtccaccgtctcgggtcacgacccaaggcccaacccacgtctcactcttaccg

SEQ ID NO: 352301 - DNA, 512 bp, Homo sapiens
  misc_feature: GZ8MTXP02FV27C.52.38.D05.1.454.CMB.2.raw
  modified_base (232)..(232): a, c, t, g, unknown or other
  misc_feature (232)..(232): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (478)..(478): a, c, t, g, unknown or other
  misc_feature (478)..(478): n is a, c, g, or t
tcagcgcagtacgacacgaccggtgctcgatttagtatctgatagttgggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatgtacagcagagcggcaggccccngtgttggngatgtataaagacactgagaggccctnagggactcccgtgagcgtacttctctggctccgaggttcacgggggacaaacgggtcaacctattcggccatcaagttggagtccaggcagaggacgaggctagacttattatagtacaattcaaacagaccacctattaggtacttatgtcttcggaactgacgacaaggtcacgtcngggtcaacgcccaacggccaacccactcgtctac

SEQ ID NO: 352302 - DNA, 581 bp, Homo sapiens
  misc_feature: GZ8MTXP02ICG7X.52.38.D05.1.454.CMB.2.raw
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctggagatgcattgaccaaacgatatgcttattggacagcagaagccggccaggccctgtgtggtgatgtataaagacactgagaggccctgagggactcccgtgagccgattctctggctccgaggtcgagggacaacggtcatagttgccactcaggtggacgtccgaggcaggaggacgaggctagacttattagtgtacaatcaaacagaacaacctagtttacggttaacttagtcgttacgttacgggtaaaacttggacgtaaacccgtaaaacgggttccgaacccggttccgttagggggtaaccaaccggaccccgaaacgggacccccaaaccccctaacgtcgtaacccc

SEQ ID NO: 352303 - DNA, 501 bp, Homo sapiens
  misc_feature: GZ8MTXP02GYRE6.52.38.D05.1.454.CMB.2.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (483)..(483): a, c, t, g, unknown or other
  misc_feature (483)..(483): n is a, c, g, or t
tcagcgcagtacgacacgaccggtgctcgatttagtatctgatagttgggtttgggggtccaggaggcagaactctgggtgtctcaccatggcctggatccctctcttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgtggtgatgtataaagacactgagaggccctnagggatccctgagcgattcnctggctcaggtcagggacacggtcacagttgccatcagtgagtccaggcagaggacgaggctgactatattgnaatcaanagacacattggtacttatgtacttcgaatgacgacaaggtccaccgtccgtcgggtcacgcccaaggcccaaacccnctcgtcacctcttacccg

SEQ ID NO: 352304 - DNA, 507 bp, Homo sapiens
  misc_feature: GZ8MTXP02GZESS.52.38.D05.1.454.CMB.2.raw
  modified_base (237)..(237): a, c, t, g, unknown or other
  misc_feature (237)..(237): n is a, c, g, or t
  modified_base (280)..(280): a, c, t, g, unknown or other
  misc_feature (280)..(280): n is a, c, g, or t
  modified_base (357)..(357): a, c, t, g, unknown or other
  misc_feature (357)..(357): n is a, c, g, or t
  modified_base (413)..(413): a, c, t, g, unknown or other
  misc_feature (413)..(413): n is a, c, g, or t
tcagcgcagtacgacacgaccggtgctcgatttagtatctgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgtggngatgtataaagacactgagaggccctcgaggggatccccgtgagcgtattcctctgctcgaggtcagggcaacggtnacattggcatcagtgagtccaggcagaggacgagctgactattatgtacaatcaanagacacattggtactatgtctcggaactgacgactaacggtcaccgtcgtcgggtcacgaaccgaacgacccaacccgactcgtaccacttccg

SEQ ID NO: 352305 - DNA, 584 bp, Homo sapiens
  misc_feature: GZ8MTXP02F8WBI.52.38.D05.1.454.CMB.2.raw
  modified_base (239)..(239): a, c, t, g, unknown or other
  misc_feature (239)..(239): n is a, c, g, or t
  modified_base (290)..(290): a, c, t, g, unknown or other
  misc_feature (290)..(290): n is a, c, g, or t
  modified_base (561)..(561): a, c, t, g, unknown or other
  misc_feature (561)..(561): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttagttggtaccagcaggaacgccgggccacggcccctgtgttggngatgtataaagcactgagcggccctgagggactcccgtgacgcgtattcctcgtggctccgaggtccgaaggggaccgaaacgggtcaacgtagttcgggccaatcgagtggactccgaggcaggaggcgagctgacttattattgacaatcaacagacactattaggtacttagtgtacgttacggaacttgaccgaaccgtaaacggtccgaacccgttccgtcgggtaccaacccggaacccgaaacgggaccccaaaacccccggtntttaccggacctaacctttcccg

SEQ ID NO: 352306 - DNA, 518 bp, Homo sapiens
  misc_feature: GZ8MTXP02GNF34.52.38.D05.1.454.CMB.2.raw
  modified_base (235)..(235): a, c, t, g, unknown or other
  misc_feature (235)..(235): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgtggtgatgtataaagacactgagacggccctcgagggactccctgacgcgattctctggctccgaggtcaggggacaacggtcacattggccatcagtgagtcagcagaggngagcngactattatgtacaatcaanagaacaccattaggtaacttagtagtcttacggaactcgacgaaccaaaggtcaccgtcgtcggtacaacgacccaacggccccaacccgactacgtactaccg

SEQ ID NO: 352307 - DNA, 666 bp, Homo sapiens
  misc_feature: GZ8MTXP02GMX85.52.38.D05.1.454.CMB.2.raw
  modified_base (235)..(235): a, c, t, g, unknown or other
  misc_feature (235)..(235): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgacgaaaccgntatgcttattggtaccagcagaagccgggccaggcccctgtgtggtgatgtataaagacactgagaggccctgagggactcccgtgagcgtattcgtctggctcgaggtcaggggacaaacgggtcacgtagttcggacctaagttccgaggttacgggacgttacccggagggaccaagggacgggaaccggaaggggtccttacggtaacttaagtttaagtttcggtactaaagttaccaaaacgtaacgaacctaaccgtaagtttacgggttaacctttagttacgttacgtttaacgggtaaaccttcggaccggtaaacccgtaaacggggttccctaacccggttacccggttggggtaccgaacgggtacccccgaaacggggtacccccaaaccccctaacgttccggttacctaaacccg

SEQ ID NO: 352308 - DNA, 533 bp, Homo sapiens
  misc_feature: GZ8MTXP02I588F.52.38.D05.1.454.CMB.2.raw
  modified_base (242)..(242): a, c, t, g, unknown or other
  misc_feature (242)..(242): n is a, c, g, or t
tcagcgcagtacgacacgaccggtgctcgatttagtatctgatagttgggtttgggggctgtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggccacggcccctgtgttggtgatgtataaagacactgagacggcctcgagggactccctgacgccgattctctcggctccgaggtcgagggacaacggtcacattcggccatcgagtggacgtccgaggcaggaggacgaggctagactattatgtacaatacaacagacacagttgtacttatcgttcttacggacttcgcgaactaacggtccaaccgtcgtgggtccacggacccgaacggacccaacccgactcgtaccc

SEQ ID NO: 352309 - DNA, 523 bp, Homo sapiens
  misc_feature: GZ8MTXP02IDRYU.52.38.D05.1.454.CMB.2.raw
  modified_base (394)..(394): a, c, t, g, unknown or other
  misc_feature (394)..(394): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatgtaccagcagaagccggcaggccctgtgtgtgatgtataaagcactgagacggccctgagggatccctgagcgattcctctggctcgaggtcagggacaacggtcacgtagttcggccatcgagtggagtccgaggcaagaggacgnggctagactattattgtacaatcaaacagacactattggtacttatgttctacgtaactcgacgacgaacgtccaaccgtccgtcgggtacacgaacccgacggacccaaccccactcgaccacttccc

SEQ ID NO: 352310 - DNA, 546 bp, Homo sapiens
  misc_feature: GZ8MTXP02H3N2F.52.38.D05.1.454.CMB.2.raw
  modified_base (222)..(222): a, c, t, g, unknown or other
  misc_feature (222)..(222): n is a, c, g, or t
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
tcagcgcagtacgacacgaccggtgctcgatttagtatctgatagttgggtttggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggatcacctgctctgganatgcattgaccaaacgatatgcttatggtaccagcagaagccggcagccctgtgttgtgatgtaataaagacacgtagagacggcccctagaggggactcccgtagagcgtattccctcgtcggcctccgagggtcgacggggaccaacgggtcactagttcggccatcagtggagtccgaggcagaggacgagtcngactattatgtacatacaaanacacactagttagtacttagtcgttacgtacgactacgacgacgacgtccgtaccgtccgtcggtaccaccgaacccgacgaccccacctactacgtcctactccg

SEQ ID NO: 352311 - DNA, 566 bp, Homo sapiens
  misc_feature: GZ8MTXP02HMVJM.52.38.D05.1.454.CMB.2.raw
  modified_base (255)..(255): a, c, t, g, unknown or other
  misc_feature (255)..(255): n is a, c, g, or t
  modified_base (321)..(321): a, c, t, g, unknown or other
  misc_feature (321)..(321): n is a, c, g, or t
  modified_base (430)..(430): a, c, t, g, unknown or other
  misc_feature (430)..(430): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccngcagaagccggcaggcccctgtgttggtgatgtaataaagacactgagaggccctgagggctcccngagcgattcctctggctcgaggtcagggcaacggtcacagttcggccatcaggtggacgtccgaggcagacggacgaggcgtagacgttattagtgtacaaattcaaanacgacaccgtagtttacggtactttagtgttacgtttacggacttcggaccgtaccgaaacgggtcccaccggttccgtacgggtaccaccggaaccccgaaggccccaaaccccgtatccgtacctaccttcccg

SEQ ID NO: 352312 - DNA, 510 bp, Homo sapiens
  misc_feature: GZ8MTXP02IH4WI.52.38.D05.1.454.CMB.2.raw
  modified_base (239)..(239): a, c, t, g, unknown or other
  misc_feature (239)..(239): n is a, c, g, or t
  modified_base (501)..(501): a, c, t, g, unknown or other
  misc_feature (501)..(501): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcgagggactcccctgagcgtattcctcgtggctccgaggtcagggacaacgggtcaacgtattgggaccatcgagtggacgtccaggcaggagacgaggctgactattattgtacaagtcaacagacacctattgtacttatgtctcgactgacacaggtcacgtctaggtcagccgaagcccaacccntcgtcactc

SEQ ID NO: 352313 - DNA, 643 bp, Homo sapiens
  misc_feature: GZ8MTXP02H59FI.52.38.D05.1.454.CMB.2.raw
  modified_base (493)..(493): a, c, t, g, unknown or other
  misc_feature (493)..(493): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctggagatgcattgaccaaaccgatatgacttattggtaccagacagaacgccggcaggcccctgtgtgtgatgtataaagacacgtgagacggcctacgagggactcccgtagacgccgtattcctcgtggctaccgagggtcgaacggggaacgaaaccgggttcaacgtagttcgggaccctaatccgaaaggttcgggaacgtcccgaagggaccgaaggaagggaccggaagggctagaaactttatttaagttgtacaaaactcgaaanaacgacaaaccttagttacggttaacttagtacgttacgttaacggaacttaggacccgtaaaccgaaacggtaccgaacccgttccgtacggggtaaccaacggaaccccgaaaacgggaccccaaaacccccgtacttacgtaacccg

SEQ ID NO: 352314 - DNA, 523 bp, Homo sapiens
  misc_feature: GZ8MTXP02H0IAW.52.38.D05.1.454.CMB.2.raw
  modified_base (222)..(222): a, c, t, g, unknown or other
  misc_feature (222)..(222): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgatatgcttattggtaccagcagaagccggcacggccctgtgttggtgatgtaataaagacactgagaggcccctgagggactcctagagcgattccctctgctcgaggtcgaagggaccaacgggtcactagttcggaccatcgagtgagtccgaggcagaggacgagctgactatattgacaatcaacagacactagtggtacttatgtctacgaactcgacacaacgtcaccgtcgtcggtcacgaacccgaacggacccaaccctatcgtacctacgtcccg

SEQ ID NO: 352315 - DNA, 580 bp, Homo sapiens
  misc_feature: GZ8MTXP02HLIVY.52.38.D05.1.454.CMB.2.raw
tcagcgcagtacgacacgaccggtgctcgatttagtatctgatagttgggtttgggggtccaggaggcagaactctgggtgtctcaccatggcctggatccctctcttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgtggtgatgtaataaagacactgagacggccctgagggactcccgtgacgcgattctctgctcgaggtcaggacacggtcacagttcgccatcgagtggacgtccgagcaggaggaacggaggctacggtatagttattagtactaaattacaaacgagtaacaaccgtagtttacgggtacttaagtcgttacgttacgggtaacttcgaccggtaaccgaaggttcccgaccggttaccgtacgggtaccgaccgacccgaaacggccccaaaccctacgtcgtacccacttcctttaccccg

SEQ ID NO: 352316 - DNA, 543 bp, Homo sapiens
  misc_feature: GZ8MTXP02F79ZY.52.38.D05.1.454.CMB.2.raw
  modified_base (240)..(240): a, c, t, g, unknown or other
  misc_feature (240)..(240): n is a, c, g, or t
  modified_base (284)..(284): a, c, t, g, unknown or other
  misc_feature (284)..(284): n is a, c, g, or t
  modified_base (526)..(526): a, c, t, g, unknown or other
  misc_feature (526)..(526): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagagccggcacggccctgtgttggngatgtaataaagacactgagacggcccctgagggactccctagacgcgtattcctcgtggcctcgaggtcgagggcaacggtcacgtagttcggccagtcgagtggagtccgaggcgaggaggacgaggctagacttagttattgtacaatacgaacagacacctagttgtacttagttgtacttcggaacttgactacgaacgtcgaccgtcgtacggtcacgccgaacggacccaacccncgtcgtaccacttcccg

SEQ ID NO: 352317 - DNA, 575 bp, Homo sapiens
  misc_feature: GZ8MTXP02HYN9L.52.38.D05.1.454.CMB.2.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
tcagcgcagtacgacacgaccggtgctcgatttagtatctgatagttgggtttgggggctgtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcacctgctctgganatgctattgaccaaacgntatgcttatgaccagcagacgccggcacggccctgtgtgnatgataaganatgagacgcctgaggactccgngagccgtattcncgtggctcgaggtcgagggacacggtcactagtcgccatcgaggtcggacgtcgagggacgaaggacggacggaggtcgtagtaacttagttattgtaacaatacgaaacagaacctaacctagttcgttaacttatcgttacgttacggaacgttcgaaccgtaaccgtaacggtaccgtacccggtaccgttagggaacccgacgaccccggaaacggaccccaaccccgtacgttaccgtaccc

SEQ ID NO: 352318 - DNA, 564 bp, Homo sapiens
  misc_feature: GZ8MTXP02IQHGN.52.38.D05.1.454.CMB.2.raw
  modified_base (549)..(549): a, c, t, g, unknown or other
  misc_feature (549)..(549): n is a, c, g, or t
tcagcgcagtacgacacgaccggtgctcgatttagtatctgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgaccaaacgatatgcttattggtaccagcagaagccggcacggcccctgtgtggtgatgtaataaagacactgagacggccctagagggactcccgtgagcgtattccgtactcggctccgaggtcgacgggacaacgggtcacagttcggacatcagtggacgtaccgaggacgagaggaccgaggctggacttattatgtacaatacaacagtaaccactagttcggtaacttagtcgttacgtttacggaacttcggaccgtaaccgaaacgtccgtaaccgtcgtacggtaccacgaacccgacggacccaaaccccngtacaccaccgttcc

SEQ ID NO: 352319 - DNA, 666 bp, Homo sapiens
  misc_feature: GZ8MTXP02GMJ32.52.38.D05.1.454.CMB.2.raw
  modified_base (223)..(223): a, c, t, g, unknown or other
  misc_feature (223)..(223): n is a, c, g, or t
  modified_base (646)..(646): a, c, t, g, unknown or other
  misc_feature (646)..(646): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgganatgcattgaccaaaccgatatgcttattggtaccagcagaagccggccaggcccctgtgtggtgatgtaataaagacacgtgagacggcccctagagggactcccgtagagcgtacttccgtctggctaccgaggtccgaagggaccaacgggtcaacgtagttcgggaccaagtccgaagtcggaacgtcccgaagggaccgaagggaacggaccggaggtaccgtaggaaaccttatttaaagtttagtaactaaaacgttaccaaaacgaacggaaacctaaacccgttagtttacgggttaaactttagttacggttaccgtttaccgggaaacttcggaaccgtaaacccgtaaacggtaccaaacccggttacgtacgggtaccaacggaaccccgaaacggaccccctaaaccccncgtacgtcccaactttcccg

SEQ ID NO: 352320 - DNA, 485 bp, Homo sapiens
  misc_feature: GZ8MTXP02JL4LU.52.38.D05.1.454.CMB.2.raw
  modified_base (241)..(241): a, c, t, g, unknown or other
  misc_feature (241)..(241): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtacagcagaanccggcaggcccctgngttgganatgtanaaananatgagagcctagaggactccgngagcgatctctgctcgagtcgacggacgaacgtacacatagcatanagtagagcgagagagagagagananatatatatanaanacaacanacacatagtatatagtctacgacgagacgacgaacgtacaccgtcgtcgtcgacgacgacgaccaaccactactc

SEQ ID NO: 352321 - DNA, 536 bp, Homo sapiens
  misc_feature: GZ8MTXP02IVR53.52.38.D05.1.454.CMB.2.raw
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtgttcccaggacagacggccaggatcacctgctctgganatgcattgaccaaacgntatgcttatggtaccagcagagcggcaggcccctgtgtgtgatgtataagacactgagaggccctgagggatccctgacgcgattctctggctcgaggtcagggacaacggtcacagttcggccatcagtggagtccaggcagaggacgagctgacttagttattgtacaatacaaactagaacacctattggtaacttagtgttcttacggaaacttgaccgtaaccgaaaggtcctaacccgtcctaggggtaccaacgaccccgaaacggaccccaaacccctacgtcgtacctacccg

SEQ ID NO: 352322 - DNA, 497 bp, Homo sapiens
  misc_feature: GZ8MTXP02FLROB.52.38.D05.1.454.CMB.2.raw
  modified_base (334)..(334): a, c, t, g, unknown or other
  misc_feature (334)..(334): n is a, c, g, or t
  modified_base (422)..(422): a, c, t, g, unknown or other
  misc_feature (422)..(422): n is a, c, g, or t
  modified_base (438)..(438): a, c, t, g, unknown or other
  misc_feature (438)..(438): n is a, c, g, or t
  modified_base (467)..(467): a, c, t, g, unknown or other
  misc_feature (467)..(467): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgctcattggtaccagcagaagccgggccaggcccctgtgtggtgatgtataaagacactgagaggccctcgagggactcctgagcgattcnctggctccaggtcagggacaaacggtcacattggccatcagtggagtcaggcagaggacgaggctagactaagttatgtacaatcaanagacacattgacttangtctcggaactgacacaaggtcaccgtcnggtcaacgccaggacccaccactcgtcacc

SEQ ID NO: 352323 - DNA, 549 bp, Homo sapiens
  misc_feature: GZ8MTXP02IL8PH.52.38.D05.1.454.CMB.2.raw
  modified_base (243)..(243): a, c, t, g, unknown or other
  misc_feature (243)..(243): n is a, c, g, or t
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
  modified_base (426)..(426): a, c, t, g, unknown or other
  misc_feature (426)..(426): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattgaccaaaccgntatgcttattggtaccagcagaagccggcacggcccctgtgttggtgatagtataaagacactgagacggccctnagggactccctgacgcgtattcnctggctcgagtcgaggacaacggtcaacgtgtcggaccatcagttgacgtcgaggcaggaggacgaggctgaacttattatgtanaatcaaacagacactagttacggtattagtgttacttacggaacttgaccgtaacgaaacggttccaacccgttcgtacggggtaacacgacccgaacggaccccaaaccctcgtcgtaaccc

SEQ ID NO: 352324 - DNA, 735 bp, Homo sapiens
  misc_feature: GZ8MTXP02IBZK7.52.38.D05.1.454.CMB.2.raw
  modified_base (238)..(238): a, c, t, g, unknown or other
  misc_feature (238)..(238): n is a, c, g, or t
  modified_base (281)..(281): a, c, t, g, unknown or other
  misc_feature (281)..(281): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatgtaccagcagaagccggcaggcccctgtgttggngatgtataaagacactgagacggccctgagggtactccccgtgacgcgatttcccgtacgtcggcttccgagggtccgaacggggtaccgaaaccgggttcaaacgtactttacggggacccagttacgaacgttcgggaacgttacccgaagggaccaaaggggaacgggaaccgggacgggtacgtaacggtaaccttatttagtttacggtactaaacttacaaacctaaggaacctaaccgtagtttacgggtttaaccttaagttcgttaccgtttaacggtaaaaccgtttcggaccggaaacccgtaaacgggttacccgtaaacccgggtttcccgttaacgggggtttaccctaaaccggggtaaccccccgtaaaaccggggaacccccccttaaaaccccccggtacgtttacccgttaacccggtaacccttttacccccgg

SEQ ID NO: 352325 - DNA, 593 bp, Homo sapiens
  misc_feature: GZ8MTXP02GV5OM.52.38.D05.1.454.CMB.2.raw
  modified_base (239)..(239): a, c, t, g, unknown or other
  misc_feature (239)..(239): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatgtacagcagagccggcacggccctgtgtggtgatgtataaagcactgagacggccctcgaggactcccgtgacgcgtattcctcgtcggcctccgaggtccgaaggggaccaacgggtcactagttcgggccctaatcgagtggacgtccagggcaaggacgggaccggaggctaggacttagtttaagttgtaccaatacaacacggacaccgtaagtttcggtaacttagttagttacttacggaacttcgaccgtaaccgtaaacggtccgtaccgtccgtacggggtaccaacgaaccccgaaacggacccctaaacccgacgtcgtacctaactttcccg

SEQ ID NO: 352326 - DNA, 563 bp, Homo sapiens
  misc_feature: GZ8MTXP02HA2MW.52.38.D05.1.454.CMB.2.raw
  modified_base (234)..(234): a, c, t, g, unknown or other
  misc_feature (234)..(234): n is a, c, g, or t
  modified_base (332)..(332): a, c, t, g, unknown or other
  misc_feature (332)..(332): n is a, c, g, or t
tcagcgcagtacgacacgaccggtgctcgatttagtatctgatagttgggctgtgggtccaggaggcagaactctcggtgtctcaccatggcctggatccctctacttctccccctcctcactctctgcacaggctctgaggcctcctatgagctgacacagccaccctcggtgtcagtgtccccaggaccagacggccaggatcacctgctctggagatgcattgccaaacgntatgcttatggtaccagcagaagccggctaggcccctgtgtggtgatgtaataaagacactgagacggccctgagggactcccgtagaggcactttcnctggactccaggtcaggggacaacggtcacattcggcatcagtgagtcaggcaggacggacgtaggctagatagttattgacaatcaacagtacactagttggtacttagtgtacgttacggaaacttcggaccgttaacccgaaaagggtccctaaccggttacccgttggggtaccaacggtaccccgaaacgggaccccaaaaccccgtacgttcgttacctaacccg

SEQ ID NO: 352327 - DNA, 574 bp, Homo sapiens
  misc_feature: GZ8MTXP02ICBSI.52.38.D05.1.454.CMB.2.raw
  modified_base (233)..(233): a, c, t, g, unknown or other
  misc_feature (233)..(233): n is a, c, g, or t
tcagcgcagtacgacacgaccggtgctcgatttagtatctgatagttgggtttgggggtccaggaggcagaactctgggtgtctcaccatggcctggatccctctcttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggcaggcccctgtgtggtgatgtataaagacactgagacggccctgagggactcccgtgacgcgtattctccgtggcctccgaggtcgaggggacacggtcaactagttggccaatcgaagtggagtcccgaggcaggaggacgaggctagacttattagttagtacaaatacaaacagaactaccctaagtttacggttaactttagtacggttacttacgggtaaaactcggtaccgaaccgtaaaggtcctaacccggtacgtcggggtacacgacccgaaacggcccaacccactcgcctactccttcccg

SEQ ID NO: 352328 - DNA, 575 bp, Homo sapiens
  misc_feature: GZ8MTXP02IBX97.52.38.D05.1.454.CMB.2.raw
  modified_base (559)..(559): a, c, t, g, unknown or other
  misc_feature (559)..(559): n is a, c, g, or t
tcagcgcagtacgacacgaccggtgctcgatttagtatctgatagttgggctgtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggactcacctgctctggagatgcattcgaccaaaccgatatgtcttattggtaccagcagaagccgggccaggcccctgtgttggtgatgtaataaagacactgagaggccctgagggactccctgacgcgacttctctgctcgaggtcgagggaccaacggtcaactagttcggacctatccgagtcggacgtccgagggcaggaggacgaggctagacttagttattcgtacaattacaaacagacaacctattggtaactttatcgttcgttacggaaacttcggaccgaaccgtaaggtacctacccgtaccgttcggggacaaccgggaccccaacgggaccccaaaacccccncgtacgttccaacccg

SEQ ID NO: 352329 - DNA, 625 bp, Homo sapiens
  misc_feature: GZ8MTXP02GOLYN.52.38.D05.1.454.CMB.2.raw
  modified_base (235)..(235): a, c, t, g, unknown or other
  misc_feature (235)..(235): n is a, c, g, or t
tcagcgcagtacgacacgaccggtgctcgatttagtatctgatagttgggtttgggggtccaggaggcagaactctgggtgtctcaccatggcctggatccctctcttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggcaggcccctgtgtggtgatgtataaagacactgagaggccctgagggactccctgagcgattctcctggctcgaggtcagggacacggtcacgtattcggccagtacgaggttcgggacgtacccgagggccgaagggagggacggacggccgtaggaacctttaatttagttaggtacctaaattcgaaaacaacgaacgaaccctagttacggttaactttaagtcgttaccgtttacggggaaaacttcggaaccgtaaacgtaaacggttcctaacccggtccgtacgggtacccacggaccccgaaacggcccccaaaaccccaccggttacgtaccctaaccttacgtttcccccg

SEQ ID NO: 352330 - DNA, 623 bp, Homo sapiens
  misc_feature: GZ8MTXP02FPEAC.52.38.D05.1.454.CMB.2.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaacgtnatagtgtattagttcgacngagaagacgggcccggacgaccgtccgttggttggttggagtagtagtaaagtaaacgactacgtaggacggaccgtacccgtaggaacgggtcctccgaggacgtacgttaccttccgttcggcgtcctacggtacggacggacggaacgtacggtacaacgtcgttacgcctagtacgtaggtacggacgaccggaggacgaaaggcgggtaacgcgtcgtagtaattaagtttgttacaacaacgtacaaacgacgaccctagtagtttacgtaatagtctacgttacgactcggacctacgtacgccgtaccgtcggtcggacaaccgaaccggaaccaccccactacgtctactacccg

SEQ ID NO: 352331 - DNA, 530 bp, Homo sapiens
  misc_feature: GZ8MTXP02GVQZP.52.38.D05.1.454.CMB.2.raw
  modified_base (234)..(234): a, c, t, g, unknown or other
  misc_feature (234)..(234): n is a, c, g, or t
  modified_base (328)..(328): a, c, t, g, unknown or other
  misc_feature (328)..(328): n is a, c, g, or t
tcagcgcagtacgacacgaccggtgctcgatttagtatctgatagttgggtttgggggtccaggaggcagaactctgggtgtctcaccatggcctggatccctctcttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagcactgagacggccctgagggatcccgtgagcgattcnctggctcgaggtcagggacacgggtcacagttgccatcaggtgagtcccgaggcaggaggacgaggctgaacttattattgtacaaatcaaacagaccacattggtacttagtgtacttacgggaactcgacgaccgaaggtccaccgtcgtcggggtaccacggtacccaaggccccaacccgactcgaccacttctcccg

SEQ ID NO: 352332 - DNA, 543 bp, Homo sapiens
  misc_feature: GZ8MTXP02GESDT.52.38.D05.1.454.CMB.2.raw
  modified_base (237)..(237): a, c, t, g, unknown or other
  misc_feature (237)..(237): n is a, c, g, or t
tcagcgcagtacgacacgaccggtgctcgatttagtatctgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacagcagagccgggcaggcccctgtgtggtgatgtataagacactgagacggccctagagggactccctgagcgtattcccgtcgtcggtcctccgaggtaccgaggggaccaacgggtcacgtagttcggaccatcaagtggaacgtccgaggcaggaggacgaggctagactattagttgtacatacaacagacactagttgtacttagtgtacgttacgaatcgacgtacgaaggtccaccgtcgcggtacacgaacccgaacggacccaacccgatcgtcctacttcccg

SEQ ID NO: 352333 - DNA, 587 bp, Homo sapiens
  misc_feature: GZ8MTXP02G0UYB.52.38.D05.1.454.CMB.2.raw
  modified_base (228)..(228): a, c, t, g, unknown or other
  misc_feature (228)..(228): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctctgganatgcattgaccaaacgatatgcttatggaccagcagaacgccggccacggcccctgtgtggngatgtaataaagacactgagacggccctgaggactcccngacgccgtattctctcggctccgaggtcgagggaacaacggtccaactagttcgccagtcaggtgacgccgaggacaggaggacgagctagacttattatgtanaaatacaaanacgaacacctagttaggtacttagtgttacgttacggaacttcggaaccgaaccgtaacggtaccaacccggttccgttcggggaacccaaccggaaccccgaaaccggaacccccaaaaccccgtaccgtttacggtaacccc

SEQ ID NO: 352334 - DNA, 605 bp, Homo sapiens
  misc_feature: GZ8MTXP02GCD7A.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcacggccctgtgtggtgatgtataaagcactgagacggccctgagggactcccgtgagcgtattcctcgtggctccgaggtccaaggggaccaacggtcaactagttcggacctagttcaggtcgacgtccgaggcaggaggacgtagctgactattatgacaatcaacagacaacctattacggtactttagtcgtacttacgggaaacttcggaccgtaaaccgaacgggtttccgaaaccggttcccgtacgggggttaccaaaccggtaaccccgtaaaaccgggtaccccaaaaccccccggttacgttaccgtaccgtacccgtttcccg

SEQ ID NO: 352335 - DNA, 515 bp, Homo sapiens
  misc_feature: GZ8MTXP02IFZSJ.52.38.D05.1.454.CMB.2.raw
  modified_base (254)..(254): a, c, t, g, unknown or other
  misc_feature (254)..(254): n is a, c, g, or t
  modified_base (418)..(418): a, c, t, g, unknown or other
  misc_feature (418)..(418): n is a, c, g, or t
  modified_base (503)..(503): a, c, t, g, unknown or other
  misc_feature (503)..(503): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtacngcagaagccggcagccctgtgtgtgatgtataagacactgagacggccctgagggactcccgtgacgcgtattcctcgtcggctcgaggtcgagggacgacggtcactattcggccatcagtgagtccaggcagaggacgagctgactattatgtacaatcaanagacacctattaggtacttatgtcgtaggaactcgacgaccgagtccaccgtcgtcgggtcacgcccgaacggacccaaacccgntcactacttccg

SEQ ID NO: 352336 - DNA, 754 bp, Homo sapiens
  misc_feature: GZ8MTXP02JJQ66.52.38.D05.1.454.CMB.2.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaaccgntatgcttattggtaccagcagaagccggcacggcccctgtgttggtnatgtataaagacacgtgagacggccctcgagggactcccgtaggacgccgtattccgtcgtcggtcctccgagggttccgaacggggtaaccaaaccgggttccaacgtacgtttacgggaccctaaagttccgaaggttcgggacgttcccgaagggacgaacgggaacggggaaccggagggtacgtaggtaaaccgtttaagtttaacgtttacggtaacctaaaagttaccgaaaaccgaacggtaaaccctaacccgttaagttttacggggttaaccctttaagttacgttacgtttaaccggggaaaacctttcggggaacccgtaaacccggtaaacgggttacccgtaaccccgggttcccggtttacgggggtaacccgtaaccgggtaacccccggaaaaccggggacccccctaaaacccccggtaccggtttaccggtttaaacccccg

SEQ ID NO: 352337 - DNA, 652 bp, Homo sapiens
  misc_feature: GZ8MTXP02IGTXV.52.38.D05.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgntatgtcttatgtaccagcagaagccggcacggccctgtgttggngatgtaataaagacacgtgaggacggccctcgagggactcccgtgacgcgtattcccgtctcggctcgaggtcgaagggacaacgggtacaacgtagttcggaccatccgaaggttcggacgtacccgaggacgaagggacggacgaggcgtacggacttaagttagttcgtacctaaattaccaaaacgacgaacctaaaccgtagtttacggtaacctttaagtcgttaccgttacggtaaaacgttcggaccgtaaaccggtaaacgtacccgtacccggttaccgttacgggtaccgaacccggaaccccgaaaccggacccccaaaacccccgtaacgttccgtacccttaacctttccccg

SEQ ID NO: 352338 - DNA, 531 bp, Homo sapiens
  misc_feature: GZ8MTXP02G9JNA.52.38.D05.1.454.CMB.2.raw
  modified_base (240)..(240): a, c, t, g, unknown or other
  misc_feature (240)..(240): n is a, c, g, or t
  modified_base (283)..(283): a, c, t, g, unknown or other
  misc_feature (283)..(283): n is a, c, g, or t
  modified_base (414)..(414): a, c, t, g, unknown or other
  misc_feature (414)..(414): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggcaggccctgtgtggngatgtaataaagacactgagacgccctgagggactcccgtgagcgtatcctcgtggctccgaggtcgagggacaacggtcactatgcatcagtgagtcaggcagagacgagctgactatatgacaatcaanagacacattgtacttatgtacttacgaactcgacgaccgtaaaggcctaccgtccgtacgggtacaacggaaccccgaaacggacccccaaaccccacgttcgacctacctttcccg

SEQ ID NO: 352339 - DNA, 677 bp, Homo sapiens
  misc_feature: GZ8MTXP02IDQHN.52.38.D05.1.454.CMB.2.raw
  modified_base (290)..(290): a, c, t, g, unknown or other
  misc_feature (290)..(290): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgcttattggtaccagcagaagccggccaggcccctgtgttggngatgtataaagacactgagacggccctgagggactcccgtgacgccgtattccgtcgtcgctaccgaggtcgagggaactaaacgggtccaacgtagttcgggaccctagtacgaggttaggacgtcccgaaggacgaagggaacggaacggagggactaggtaactttagtttattacggtactaaaacttcaaacgacgaacctaaccgttagtttacggttaacttagttacgttaccgtttaacggaacgttcggacccgtaaaacccggtaacggttacccgtaaacccggtttccggttaccggggtaaccgtaacccggaacccccggtaaaaccgggtaccccccaaaacccccggttaccttaccggtttaacccccg

SEQ ID NO: 352340 - DNA, 540 bp, Homo sapiens
  misc_feature: GZ8MTXP02FZG7E.52.38.D05.1.454.CMB.2.raw
  modified_base (282)..(282): a, c, t, g, unknown or other
  misc_feature (282)..(282): n is a, c, g, or t
  modified_base (338)..(338): a, c, t, g, unknown or other
  misc_feature (338)..(338): n is a, c, g, or t
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttatggtacagcagagccggcagccctgtgtgnatgtataaagacacgtgagacggccctgagggactcccgtaggacgccgtattccncgtcggctaccgaggtcgagggacaaacggtcacagttcggccatcgaggtggacgtccgaaggcaggacggacggnggactgacttattatgtanaatcgaaanacgacactagttagtacttagtgtacttacgaactgaccgacgaacgtccaccgtccgtaggtaaccacgaccgaacggacccaacctacttcgacc

SEQ ID NO: 352341 - DNA, 634 bp, Homo sapiens
  misc_feature: GZ8MTXP02HVH9H.52.38.D05.1.454.CMB.2.raw
  modified_base (285)..(285): a, c, t, g, unknown or other
  misc_feature (285)..(285): n is a, c, g, or t
tcagcgcagtacgacacgaccggtgctcgatttagtatctgatagttgggtttgggggtgggtccaggaggcagaactctgggtgtctcaccatggcctggatccctctacttcctccccctcctcactctctgcacaggctctgaggcctcctatgagctgacacagccaccctcggtgtcagtcgtccccaggacaggacggccaggatcacctgctctggagatgcattcgaccaaacgatatgtcttatgtaccagcagacgccggcacggccctgtgtgngatgtaataagacacgtgagacggccctagacgggtactcccgagacgcgtacttccctcgtcggctcgaggtacgacgggtaccacgggtacacgtacgttcgaccagtcgagtcggacgtccgaggcgaggaggacgaggactaggtacttaattagtacgtaacaacttacaaacgtacggaacctaaccgtaagtttacggttaacctttagtccggtttacgttaccgggaaaacttcggaaacccggtaaccgaaacggttccgtaacccggttccggtacggtaccgaccggaaccccgaaacggacccccaaaccccggtatcccgtaccttacctccccg

SEQ ID NO: 352342 - DNA, 506 bp, Homo sapiens
  misc_feature: GZ8MTXP02ILWDE.52.38.D05.1.454.CMB.2.raw
  modified_base (239)..(239): a, c, t, g, unknown or other
  misc_feature (239)..(239): n is a, c, g, or t
  modified_base (281)..(281): a, c, t, g, unknown or other
  misc_feature (281)..(281): n is a, c, g, or t
  modified_base (294)..(294): a, c, t, g, unknown or other
  misc_feature (294)..(294): n is a, c, g, or t
  modified_base (420)..(420): a, c, t, g, unknown or other
  misc_feature (420)..(420): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaacgntatgcttattggtaccagcagaagcggcaggccctgtgtggngatgtataaaganactgagaggcccctcgaggggactcccctgacgcgattcctcgtgctccgaggtcagggacaacggtcactatggcatcagtgagtcaggcagaggacgaggctagactattattgtacaatcaanagaacaccatgtacttatgtcgtcgaactcgacacaaggtcacgtctacggtcacgaacccaacggcccaaccactcgtacactcc

SEQ ID NO: 352343 - DNA, 506 bp, Homo sapiens
  misc_feature: GZ8MTXP02G6YPP.52.38.D05.1.454.CMB.2.raw
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgntatgcttatggtaccagcagaagccgggccaggcccctgtgttggtgatgtataaagacactgagaggccctgagggactccctggacgcgacttctcgtggctcgaggtcgaggggacaacgggtcactagttcggccatacgagtggagtccgaggcgagaggacgagctagactattatgtacaatcaacagacacctagttgtacttatgtctcggaactgacgacagtcaccgtcnggtacncgaccacggccaacccactcgctacc

SEQ ID NO: 352344 - DNA, 574 bp, Homo sapiens
  misc_feature: GZ8MTXP02I066V.52.38.D05.1.454.CMB.2.raw
  modified_base (245)..(245): a, c, t, g, unknown or other
  misc_feature (245)..(245): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (450)..(450): a, c, t, g, unknown or other
  misc_feature (450)..(450): n is a, c, g, or t
  modified_base (563)..(563): a, c, t, g, unknown or other
  misc_feature (563)..(563): n is a, c, g, or t
tcagcgcagtacgacacgaccggtgctcgatttagtatctgatagttgggtttgggggctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatccacctgctctggagatgcattgaccaaacgntatgcttattggaccagcagaacgccggcacggcccctgtgtggnatgtaanaaagacacgtgagacggtccctcgaggtactcccgtaggacgccgtattcctctggcctcgaggtcgagggaacaacggtcacgtatcggaccatcgaggtgacgtccgaggcaggaggtacgaggctgaactattatcgtacaaatcgaaanacgaaccactagttacggtactttagtacgtcgtttacgaaacttcgaccgaaccgtaaacggtcctaaccgtcgtacgggaaccacgacccgaaacggccccctaaaacccncgtactacccg

SEQ ID NO: 352345 - DNA, 572 bp, Homo sapiens
  misc_feature: GZ8MTXP02FNXON.52.38.D05.1.454.CMB.2.raw
  modified_base (236)..(236): a, c, t, g, unknown or other
  misc_feature (236)..(236): n is a, c, g, or t
  modified_base (280)..(280): a, c, t, g, unknown or other
  misc_feature (280)..(280): n is a, c, g, or t
  modified_base (323)..(323): a, c, t, g, unknown or other
  misc_feature (323)..(323): n is a, c, g, or t
tcagcgcagtacgacacgaccggtgctcgatttagtatctgatagttgggtttgggggtccaggaggcagaactctgggtgtctcaccatggcctggatccctctcttctccccctcctcactctctgcacaggctctgaggcctcctatgagctgacacagccaccctcggtgtcagtcgtccccaggacagacggccaggatcacctgctctggagatgcattgaccaaaccgntatgcttatggtaccagcagaagccggcaggcccctgtgttggngatgtataaagacactgagaggccctgagggactccctgacgntattctctgctcaggtcaggacacggtcacgtagttcggacctataccgagttgggaagttacccgagggacaggaacgggacggaaggctaggtaacttatttagttgtaacaattacaacagtaaccacctaattggtaacttagtgtacttacggattcggacgtaaaccgaaggtcctacgtaccgttcggggaccacggacccgaaacggcccaaacccctactcgtaccactcgtttaccccg

SEQ ID NO: 352346 - DNA, 613 bp, Homo sapiens
  misc_feature: GZ8MTXP02JK505.52.38.D05.1.454.CMB.2.raw
  modified_base (277)..(277): a, c, t, g, unknown or other
  misc_feature (277)..(277): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccggcaggcccctgtgtggnatgtaataaagcactgagacggccctgagggctcccgtggacgcgtacttcgctcgctcgagtgacgggacaaacggtcaactgttcggaccagtacaggtggacgaccgaggccgaggacgggaagacggctaggacttaaattagtttacgaactaaagacaaacgaagaaccctaacctagttacgttaattaagttcgttaccgttaacgggaaacttcggaaccggtaaaccgaaaacggggtccctaacccggtttaccgtcggggtaaccaaccggtaccccgaaaaccgggccccccaaaaaccctaccggtttccgaaccttacccg

SEQ ID NO: 352347 - DNA, 649 bp, Homo sapiens
  misc_feature: GZ8MTXP02HJKV0.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcacggcccctgtgtggtgatgtaataaagacactgagacggccctacgagggactccccgtaggacgtacggtactttcccgtcgtcggtcctacccggtaggtaccggaacggggaccgtaaaccgggtcaaaccgtacgtttccgggaccacgtccgtaagggtcggacgtacccgagggaccgaagggaacggacggaggtccgtagtaacttatttagttagtactaaataccaaacacgaacctacctagttacggttacttagttcgttacgtacggtaacttacgaccgtaacgaacggtaccgtaccgtaccgttacggaccaccggaacccgaacggaccccaaccctacgtaccgtacctacctttcccg

SEQ ID NO: 352348 - DNA, 678 bp, Homo sapiens
  misc_feature: GZ8MTXP02JSYTX.52.38.D05.1.454.CMB.2.raw
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
tcagcgcagtacgacacgaccggtgctcgatttagtatctgatagttgggtttgggggtccaggaggcagaactctgggtgtctcaccatggcctggatccctctcttctccccctcctcactctctgcacaggctctgaggcctcctatgagctgacacagccaccctcggtgtcagtcgtccccaggacagacggccaggatcacctgctctggagatgctattcgaccaaaccgatatgtcttagttcggtaccagcgagaacgcccgggaccacggcccctgtgttggtgtatgtaataaagacactgagacggccctgagggtactccgngagcgtattctccgngctcgaaggtcgagggacacgggtcacgtagttcggacctaagtcgaggtcggacgtcccgaggaccgaagggaacgggacgtagggccgtagtaacgttagtttaagttacgtactaaattaccgaaacgaacgaaccgtaaacctagtttagggttaacctttagttacggtttaccgttaccggtaaactcggtacccgtaaaccgaagggttaccccgaacccggttccgttaccgggggtacctaacccggaacccccgaaaccggacccccctaaaaacccccgcgttaccggtacccctaccggttcctttaaccccccgg

SEQ ID NO: 352349 - DNA, 703 bp, Homo sapiens
  misc_feature: GZ8MTXP02JBIYO.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaaccgatatgtcttattcggtaccagcagaacgccgggccacggcccctgtgttggtgatagtaataaagacacgtagagacggccctacgagggactccccgtgacgtcgtacttcccgttcgtcggtcctacccggtaggtaccgaacggggaccgaaaccgggttcaacgtagtttccgggactaacgttaccgaagggttagggaacgttacccgaagggaccgagggaaggaccggaaggccgtaggtaacttatttagttacggtaactaaacttacaaacacggtaaccaaaccgtagtttacggtaactttaagtgttaccgtacgtaacgtcggaccgtaaacggtaacggtaccgtaacccggttcgtaccggggttaccaaccggtaaccccgtaaaaccgggggaccccctaaaacccccgtaacggttcccgttaaccgtacctttcccccgg

SEQ ID NO: 352350 - DNA, 584 bp, Homo sapiens
  misc_feature: GZ8MTXP02F0G4P.52.38.D05.1.454.CMB.2.raw
  modified_base (240)..(240): a, c, t, g, unknown or other
  misc_feature (240)..(240): n is a, c, g, or t
  modified_base (566)..(566): a, c, t, g, unknown or other
  misc_feature (566)..(566): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttattcggaccagcagaacgccgggcacggccctgtgtggtgatgtaataaagacatgagacggcctgaggactccctgacgcgtattccctcgtcggctccgaggtcgacgggacctaacggtcaacgtagttcggactagtacgaggtggacgtccgaagggcaaggaggacgaggctagtactatttagtgtacaagtacaacgagaacctactagttacggtacttagtcgttacgtacggaactcggaccgaaccgtaacgtcccgtacgtcccgtacgggccaccgaacccgaaaccggccctaaacccccggtntaccgtacctacttcccg

SEQ ID NO: 352351 - DNA, 650 bp, Homo sapiens
  misc_feature: GZ8MTXP02GASYP.52.38.D05.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (283)..(283): a, c, t, g, unknown or other
  misc_feature (283)..(283): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgctattgaccaaacgntatgcttatggtaccagcagaagccggcacggccctgtgtgngatgtataaagcatgagacggccctagagggactcccgtgacgcgtacttccgtcgtcggctaccgaggtaccgaacggggaccgtaaaccgggtcaaacgtacgttacgggaccctagtacccgtaggtgggtaaccgtacccgaaggggacaagggaagggaaccggagggtctagggaaaccttatttaacgttacggttacaaaattacccgaaaagaacgtaaacctaaccgttagtttacggttaactttagtcgttaccgttacggtaacttacggaccgtaacgtaacggtccgtaaccgttcgttacgtaccgaccgaacccgaaccgaccctaaccctacgtacgtacctacttccg

SEQ ID NO: 352352 - DNA, 666 bp, Homo sapiens
  misc_feature: GZ8MTXP02HTKXQ.52.38.D05.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtcccaggacagacggccaggatcacctgctctgganatgctattgaccaaacgntntgcttattcgacagcagaagccggccaggcccctgtgtggtgatgtaataaagacactggacgaggccctacgaggactccgtgacgccgtattctcgtcggtcctccgagggtcgaacgggaacgtaacggtacacgtagttcgacccagttccgaggttggacgtccgaaggcgaagggacggacggaaggtctacggtaacttatttagttacgtactaaatacgaaacacgtaaccaaccgttaggtttacggttaaactttacgttacggttaccgtttacggaaccggtttcggaaacccgtaaaccggtaaccgggttaaccgtccccggtttaccggtacggggttaacccgaaccggaaccccggtaaaccgggaaccccctaaacccccgtacgtttaccggttaacccccg

SEQ ID NO: 352353 - DNA, 620 bp, Homo sapiens
  misc_feature: GZ8MTXP02ICVFE.52.38.D05.1.454.CMB.2.raw
  modified_base (290)..(290): a, c, t, g, unknown or other
  misc_feature (290)..(290): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgtcttattggtaccagcagaagccgggcacggcccctgtgttggtnatgtaataaagcactgagacggccctgagggactcccgtagacgccgtacttcctcgttcggccgttcccagggtcgacggggaacaaacgggtcacgagttcgggaccagtcgaggtcggaacgtccgaggcagaggacgaggctgactattattgtacaatcaaacagaccactagttacggtactttaagtcgttacgtttacggaaacttcggaccgtaaaccgaaacggttcccaacccggttcccgttacgggggtaacccaaaccgggtacccccgaaacggggtaaccccctaaaacccccgaacgttaccgtttaaccccg

SEQ ID NO: 352354 - DNA, 583 bp, Homo sapiens
  misc_feature: GZ8MTXP02GGXC3.52.38.D05.1.454.CMB.2.raw
  modified_base (242)..(242): a, c, t, g, unknown or other
  misc_feature (242)..(242): n is a, c, g, or t
  modified_base (287)..(287): a, c, t, g, unknown or other
  misc_feature (287)..(287): n is a, c, g, or t
  modified_base (424)..(424): a, c, t, g, unknown or other
  misc_feature (424)..(424): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctggtgtcaggtcgtcccaggacagacggcaggatcacctgctctggagatgactattcgacccaaacgntatgtcttagttggtaccagcagaacgccggccagccctgtgtgngatagaataagcagtgagcggcccctaggaggactcccgtagacggtcgtactttccgtcgtcggtctacggtacgggacgaacgggacctacgggacacctagttcggaccagtcaaggtcggtagacccgagganagggacgacggtacgagttacgatatttagtcgtaaacatacgaacacgactacgtagttacgttacgtacgtacgtacgtacgtacgtacgtacgacgtacgtacgtaccgtacgtacgacgacgaaccgaccgaccgacctacgtactactactacg

SEQ ID NO: 352355 - DNA, 588 bp, Homo sapiens
  misc_feature: GZ8MTXP02IR3YP.52.38.D05.1.454.CMB.2.raw
  modified_base (242)..(242): a, c, t, g, unknown or other
  misc_feature (242)..(242): n is a, c, g, or t
  modified_base (312)..(312): a, c, t, g, unknown or other
  misc_feature (312)..(312): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaacgntatgcttatggtaccagcagaagcggccaggcccctgtgtggtgatgtataaagacactgagaggccctnagggatccccgtgacgccgtattcctctcggtctcccgaggtccgaggggacaaaccgggttccacgtatttgggcccaattccgagttggaagtcccgaaggcaggaggacgaggctggactagtttatgttacaatcaaaccgtagaccacctagtttacggtactttaactgttccgtttaacgggaacctttaggccgtaaacccgaaggttcccaaccggttcctggggtaaccgacgcccgaaacgggtcccaaaccccctgtacgtacc

SEQ ID NO: 352356 - DNA, 606 bp, Homo sapiens
  misc_feature: GZ8MTXP02GHIE8.52.38.D05.1.454.CMB.2.raw
  modified_base (227)..(227): a, c, t, g, unknown or other
  misc_feature (227)..(227): n is a, c, g, or t
  modified_base (334)..(334): a, c, t, g, unknown or other
  misc_feature (334)..(334): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgcattcgaccaaaccgatatgtacttattggtaccagcagaacgccggcacggcccctgtgtggtgatgtaataaagacactgagacggccctgagggactccgngacgccgtacttctcgtcggctccgaggtcgacgggacaacggtcactgtcggccatcgagtcggagtccgaggcgaggaggacgagctagacttagttattagtacaaatacgaaacacgaacaccgtagttacggtaactttagtcgttacgttacggtaaacgttcggaccgtaaccggtaacggtcccgtaacccggttccgttacggggtaaccaccgggaaccccgaaacggaccccctaaaaccccgtcgttaccgttaaccccg

SEQ ID NO: 352357 - DNA, 560 bp, Homo sapiens
  misc_feature: GZ8MTXP02ICGAW.52.38.D05.1.454.CMB.2.raw
  modified_base (222)..(222): a, c, t, g, unknown or other
  misc_feature (222)..(222): n is a, c, g, or t
  modified_base (446)..(446): a, c, t, g, unknown or other
  misc_feature (446)..(446): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaacgatatgcttatgtaccagcagaagccggcacggccctgtgttggtgatgtaataaagacacgtgagacggccctagagggtactccccgtgagcgtatttccctcgtcggctcgaggtacgacgggactaacgggtcaacgtagttcggcctatccgagttggacgtccgaggcgagaggacgaggctagactatattgacatacaanacgacactagttagtacttagtgttacgttacgaactcgacgtaccgaaagtccaccgtcgtcgggtaccacgaacccgacggaccccaacccgtactacgtacctacgttccc

SEQ ID NO: 352358 - DNA, 542 bp, Homo sapiens
  misc_feature: GZ8MTXP02GK64T.52.38.D05.1.454.CMB.2.raw
tcagcgcagtacgacacgaccggtgctcgatttagtatctgatagttgggtttgggggctgtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcacctgctctggagatgcattcgaccaaacgatatgcttattggtaccagcagaacgccggccaggcccctgtgttggtgatgtataaagacactgagacggcctcgagggactcccgtgacgccgtattcctcgtggcctccgagggtcgagggacaacggtcactagttcggccagtctaggtggacgtccaggcaggacggacgaggctgactattattgacaatacaacagacacctagttacggtacttatcgtacttcggaactgacgtacaacggtcaccgtcgtgggtaacacggaccgaacggcccaaaccctctcgtacc

SEQ ID NO: 352359 - DNA, 619 bp, Homo sapiens
  misc_feature: GZ8MTXP02HKUZH.52.38.D05.1.454.CMB.2.raw
  modified_base (240)..(240): a, c, t, g, unknown or other
  misc_feature (240)..(240): n is a, c, g, or t
  modified_base (284)..(284): a, c, t, g, unknown or other
  misc_feature (284)..(284): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaacgntatgcttatggtaccagcagaagccggcacggccctgtgtggtnatgtaataaagacactagagacggccctagagggtactcccgtagagcgtattccctcgtgctacgaggtcgagggaccgaacggtcacgtgttcggctagtcgagttaggacgtcgaggcgaagacggacggaggtctagaccttagtttagttcgtaactaacttacgaaacaacggtaacctaaccgttagtttacggtaaacttttagtacgttacgtttaacggaacgttacggacccgtaaccgtaacgggtccgtaaccggtccgtacgggtcaaccggcccgaaacggtacccccaaacccggtactccggtacctacgtttccccg

SEQ ID NO: 352360 - DNA, 758 bp, Homo sapiens
  misc_feature: GZ8MTXP02FKEGZ.52.38.D05.1.454.CMB.2.raw
  modified_base (224)..(224): a, c, t, g, unknown or other
  misc_feature (224)..(224): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctactctgganatgcattgaccaaacgatatgtcttatgtaccagcagacgccggcacggccctgtgttggtgatagtaataaagacacgtgaggacgcctcgagggactccgtagacgcgtacttctccgtcggtcctacgagggtacgaacggggtaaccaccggggttccaacgtacgttcgggaccctaagtccggtagggttaggggaccggttacccgaacggggaccgaaggggaaccggggaacggacggggtacccttaaagggtaccgtttaaatttaacgtttacgggttaaaccaaaacgttaccctaaaacgaaaccggtaaacccttaaacccgttaagtttaacgggtttaacctttaaggtttccggttaacggtttaaccggtaacgttaccggaacccggtaaaaccggtaccggttaacccgtaaaccccggtttccggtacgggttacccaaccgggtacccccgaaccggaacccccaaaccccggttactaccgtacccttaacccgttccgtttccccccgg

SEQ ID NO: 352361 - DNA, 622 bp, Homo sapiens
  misc_feature: GZ8MTXP02GE2DM.52.38.D05.1.454.CMB.2.raw
  modified_base (241)..(241): a, c, t, g, unknown or other
  misc_feature (241)..(241): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgtcttattggtaccagcagaacggccgggccacggcccctgtcggttggtgatagtaataaagacatgagacggccctagagggtactcccgtgacgcgtattccctcgtggcctccgaggtcgaaggggacaaccgggtcacgtagttcggacctatcgaggttcggaacgtcccgaagggcaagggacggacgaggctagacttattagttgtacaatacaaacacgactactagttacgttaacttagtcgttacgtacgtaaactcggaccgtaaccgtaaacggtcccaaccggttccgtacggggtacctaacccggaacccgtaaaccggaccccaaacccccgtacgtaccggtaccctacgtttccccg

SEQ ID NO: 352362 - DNA, 596 bp, Homo sapiens
  misc_feature: GZ8MTXP02F5MA4.52.38.D05.1.454.CMB.2.raw
  modified_base (239)..(239): a, c, t, g, unknown or other
  misc_feature (239)..(239): n is a, c, g, or t
  modified_base (433)..(433): a, c, t, g, unknown or other
  misc_feature (433)..(433): n is a, c, g, or t
  modified_base (574)..(574): a, c, t, g, unknown or other
  misc_feature (574)..(574): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtacagcagaagccggcaggcccctgtcgttggagatgtataaagacacgtgagacgccctagagggactccctagagcgtattcctcgtcggctacgaggtcgagggacgaaacggtcacgtagttcggacctaagtcaagttggacgtcccgaagggcaaggaggaccgaggctgaacttnttagttgactaactcaaacgagaccacctagttacggttacttatcgttacgtttacgggaacttcggacgaaccgtaacggtacaacccggttccgtacgggtccaacggaaccccgaaacgggacccctaaaacccccngtaccgtaccgacctttcccgg

SEQ ID NO: 352363 - DNA, 631 bp, Homo sapiens
  misc_feature: GZ8MTXP02FWFVY.52.38.D05.1.454.CMB.2.raw
  modified_base (223)..(223): a, c, t, g, unknown or other
  misc_feature (223)..(223): n is a, c, g, or t
  modified_base (291)..(291): a, c, t, g, unknown or other
  misc_feature (291)..(291): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgacccaaacgatatgtcttagttcggtaccagcagaacgccgggcacgccctgtgttggngatagtataaagacacgtgagacggccctagacgggtactcccgtgacgacgtattcctcgtcggctccgaggtcgaagggaccgtaacggtcacgagttcggaccagtcgagtggacgtaccgaggcaaggacggacgaggctagactattagttgtacgaaatcgaaacagaacctaaccagtttacggtaactttagtcgttacgtacggtaacgtacgtaccgtaaccgtaaacgggtcccgtaaaccggttccgttacggggtaaccctaacggaacccccgaaaacgggtaccccctaaaaccccgacgttaccggtacctaccgtttaccccg

SEQ ID NO: 352364 - DNA, 666 bp, Homo sapiens
  misc_feature: GZ8MTXP02G9ZTO.52.38.D05.1.454.CMB.2.raw
  modified_base (241)..(241): a, c, t, g, unknown or other
  misc_feature (241)..(241): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctggagatgctattcgaacccaaaccgnttatgtcttatcggtaccagcaagaacggcccgggccacggcccctggtcgttggngatgtaaanaaagacagtgaggacggccccgtagagggactcccgngacgctacttctcgtcggcctaccggtaggtcgaggggaccaaacgggtccaacgtacgttcggacctatacgaggtacggacgtccgaggacgaggacgggacgacggcttagaacttagttacgttataaccaataccaaacgaacacctaaccgtaagtttacggtactttagtacgttacgtacggtaaacgttcggaaccgtaaaccgtaaacgggttccaaaccccgggttccgtacggggttaacccaaccggtaacccccgaaacccgggaccccctaaaaacccccggtccttaaccggtacccttaacccccg

SEQ ID NO: 352365 - DNA, 542 bp, Homo sapiens
  misc_feature: GZ8MTXP02FU0OV.52.38.D05.1.454.CMB.2.raw
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (431)..(431): a, c, t, g, unknown or other
  misc_feature (431)..(431): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcngganatgcattgaccaaacgntatgcttattggtaccagcagaagccggccacggcccctgtgtggtgatgtataagacactggagacggccctgagggactccgtgagccgtattctcgtggctccgaggtcgaagggtacaacggtcactagttcggcctatcgaggtgacgtccgagcaggaggacgaggctagacttatatcgtanatacaaagacacactagttcggtacttagtcgtacgtacggatcgaccgtacgaaacgtcctacccgtcgtacgggtcaccgaccgaacggccctaaaccgctacgtaccc

SEQ ID NO: 352366 - DNA, 720 bp, Homo sapiens
  misc_feature: GZ8MTXP02GPYUR.52.38.D05.1.454.CMB.2.raw
  modified_base (504)..(504): a, c, t, g, unknown or other
  misc_feature (504)..(504): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgacccaaacgatatgtacttagttcggtacagacagaacggccgggaccacggtcccctggtgttggtagagtagtaaataaagacactggacgacggacccgacgacggtactcccgtaggacgacgtacttcccgtacgtcggtacctcggacggtaccgaaggggtaccgaacgggtacaacgtaagttccggaccaagttacgaggttacggacacccgaaggccaagggacggaccggaaggcctaggtaaacttaatttagttanaacttaaaacgtacaaaacgaaccgtaaacaacccgtagtttacggttaaacctttagttacgtaaccgtttaacgggaaaccgtacggtaacccgaaaccggttaaaacggtcccgtaaacccggttccggttaaaccggccgaaaaccgaaccccccgtaaaacggtaacccccccaaaacccgtccgtacggtaaccctaccccgtttccccg

SEQ ID NO: 352367 - DNA, 659 bp, Homo sapiens
  misc_feature: GZ8MTXP02JS1VK.52.38.D05.1.454.CMB.2.raw
  modified_base (291)..(291): a, c, t, g, unknown or other
  misc_feature (291)..(291): n is a, c, g, or t
  modified_base (338)..(338): a, c, t, g, unknown or other
  misc_feature (338)..(338): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctggagatgcattgaccaaacgatatgtcttagttggtaccagcagaacggccggccacggccctgtgttggngagtgtaataaagacacgtgaggacggccctacgagggacttcccgngagcgtattccgtcgtggtcctaccgtaggtccgaaggggaccgaaacgggtcaacgtagtttcggacctagtacgtagggtacgggtacgtacccgagggacgaaggaacgggacggacggtactagggtaacttattagttgttaaccaaatacccaaagaaccgaataaacccgtaagtttacggttaacttacgttacgttaccgtttaacgaaacgttcggaccgtaaaccgtaaacggtccgtaaacccgttcggtcgggttacccacgaacccgaaaccggccccaaccccgtactccgtacctaccgttcccc

SEQ ID NO: 352368 - DNA, 635 bp, Homo sapiens
  misc_feature: GZ8MTXP02F0LLV.52.38.D05.1.454.CMB.2.raw
  modified_base (225)..(225): a, c, t, g, unknown or other
  misc_feature (225)..(225): n is a, c, g, or t
tcagcgcagtacgacacgaccggtgctcgatttagtatctgatagttgggtttgggggtgggtccaggaggcagaactctgggtgtctcaccatggcctggatccctctacttcctccccctcctcactctctgcacaggctctgaggcctcctatgagctgacacacgccaccctcggtgtcagtcgtccccaggacagacggccaggatcacctgctctgganatgcattgaccaaacgatatgtcttattggtaccagcagaagccgggcacggcccctgtgtggtgatgtaataaagacacgtagagacgccctacgagggactcccgtagacgacgtacttccgtcgtcgctaccgaggtccgaaggggaccaacgggtcaacgtagttcgggacctagttcgagttggaacgtaccgaacggcgaaggaagggacgaagggctacggaaacttagtttattacggtactaaataccaaacaacgaactaacctagttacggttaactttaagtcgttacgttacggaaacttcggaccgaaaccggacggttaccaaccggttccgtacggggtaccaacgaaccccgaacggaaccccctaacccagtacccgttacaaccgtttccc

SEQ ID NO: 352369 - DNA, 522 bp, Homo sapiens
  misc_feature: GZ8MTXP02GSCVO.52.38.D05.1.454.CMB.2.raw
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (423)..(423): a, c, t, g, unknown or other
  misc_feature (423)..(423): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgccaaacgntatgcttatgtaccagcagaagccggcaggcccctgtgtggtgatgtataaagacactgagacggccctgagggatccctgagccgattctctggctccgaggtcgagggactaacggtcacattggaccatcagtggagtccaagcagaggacgaggctagactattatgtacaatcaanagacactattgtattatgtcttcggaactgcgaactaaggtccaaccgtccgtagggaacacgacccgaaacggcccaaaaccccttacgtcgtaaccc

SEQ ID NO: 352370 - DNA, 626 bp, Homo sapiens
  misc_feature: GZ8MTXP02GOVBD.52.38.D05.1.454.CMB.2.raw
  modified_base (246)..(246): a, c, t, g, unknown or other
  misc_feature (246)..(246): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgacccaaacgntatgtcttattggtaccagcagaacgccgggccacggcccctgtcggttggtgagttgtaataaagacactaggagacggtccctagagggactcccgtagacgccgtattcctcgtggcctccgaggtcgacgggacaacggtcacgattcggccatcgagtggacgtccgaggacgaggacggacgagggactaggtaacttagttaagttcgtaacaaacttacaaaacgacgaacctaacctagttacgggttaacctttaagtcgttaccgtttacggtaaacgttcggaccgtaaccgtaacgggtcctaacccggttcccgtaggggtccaaccggacccgaacggacccccaaacccgtacgtacgtacccc

SEQ ID NO: 352371 - DNA, 508 bp, Homo sapiens
  misc_feature: GZ8MTXP02FPIZV.52.38.D05.1.454.CMB.2.raw
  modified_base (338)..(338): a, c, t, g, unknown or other
  misc_feature (338)..(338): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagagggccctcgagggatcctgagccgattcnctggctccgaggtcaggggacaacggtcacattggccatcagtggagtccaggcagaggacgaggctgactattattgtcaatcaaacagacacagttgtacttatgtctcggaactgacgaccaaggtccaccgtctgggcacgcccaacggcccaacccactcgtacc

SEQ ID NO: 352372 - DNA, 555 bp, Homo sapiens
  misc_feature: GZ8MTXP02FZNGQ.52.38.D05.1.454.CMB.2.raw
  modified_base (238)..(238): a, c, t, g, unknown or other
  misc_feature (238)..(238): n is a, c, g, or t
  modified_base (282)..(282): a, c, t, g, unknown or other
  misc_feature (282)..(282): n is a, c, g, or t
  modified_base (540)..(540): a, c, t, g, unknown or other
  misc_feature (540)..(540): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtacagcagaagccggcaggcccctgtgttggngatgtataaagacactgagacggccctcgagggactccccgtgacgcgtattcctctggctccgaggtcagggacacggtcacattggccatcgagtggagtccgaggcaagaggacgagctgactattattgacaatacaacagacaacctagttacggtaactttagtgttacgttacggaacttcgaccgtaaccgtaaacgggtcctaaccggtccgtacggggtccacggcccgaaacggcccaaaaccccgntcgtaccacttcccg

SEQ ID NO: 352373 - DNA, 614 bp, Homo sapiens
  misc_feature: GZ8MTXP02IPU1O.52.38.D05.1.454.CMB.2.raw
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
  modified_base (406)..(406): a, c, t, g, unknown or other
  misc_feature (406)..(406): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgacaaaccgntatgcttattggtaccanacagaacgccggccgacggccccgtcgtgttggtgatgtataaagacactagagacgcctcgacggagtccgtgagccgtacttctctgtctccacggcgagggacgaacgtacgaactcgttggccatacgagtgaacgtcccggngacgaggacggacggaggacgtacgtacttattaagttagtactaactaacaaacaacaacgtaacgttaacgtttaacgttacgttacgttacgttacgtacggtaacgtacggtaccggtaaaccggtaaccggtaccgtacccggtccggtacggtaacgaccgaacccgaacccgaccccgtaaccccgtaccgtaccgtaccg

SEQ ID NO: 352374 - DNA, 577 bp, Homo sapiens
  misc_feature: GZ8MTXP02GJS5S.52.38.D05.1.454.CMB.2.raw
  modified_base (277)..(277): a, c, t, g, unknown or other
  misc_feature (277)..(277): n is a, c, g, or t
  modified_base (285)..(285): a, c, t, g, unknown or other
  misc_feature (285)..(285): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctcgtggagatgcattcgaccaaacgatatgcttatggaccagcagagccggcacgccctgtgtgngatgtaanaaagacatgagacggccctgagggactccgtgagcgtacttcgtcgtggcctccgaggtcgacggggacaacgggtcacgagttcggaccatcgtagtggacgtaccgaggcgaggagggacgagggtctagtaacttagtttattacgtacaaatacaaacagaccacgttaagttcggttaacttagtcgttacgtacggaactcggacgaccgtaaacggtcctacccgtccgtaggtccaaccggacccgaaccggaccccctaaccccacgttacgtaccctacccg

SEQ ID NO: 352375 - DNA, 605 bp, Homo sapiens
  misc_feature: GZ8MTXP02F0GVE.52.38.D05.1.454.CMB.2.raw
  modified_base (292)..(292): a, c, t, g, unknown or other
  misc_feature (292)..(292): n is a, c, g, or t
  modified_base (505)..(505): a, c, t, g, unknown or other
  misc_feature (505)..(505): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaaccgatatgtcttagtcggtaccagcagaacgccgggccacggccctgtgttgngagtgtaataaagacactgagacggccctgaggtactcccgtgacgcgtatcccgtcgtcggcctacggtaggtaccgaagggaccgtaaacgggtcaaacgtagttaccgggcctaagtcgagttcgacgtccgagggacaggacggacgagtctagtaactattacttgtaacaactagaaacacgaaccactagttacggttattacgtntacgtttacgaacttcggacgaacgtaacgtccgaaccgttccgtagggtccaaccggaaccgaaccggtaccaacccgtacgtacgtaccactttcccg

SEQ ID NO: 352376 - DNA, 609 bp, Homo sapiens
  misc_feature: GZ8MTXP02IVJNS.52.38.D05.1.454.CMB.2.raw
  modified_base (291)..(291): a, c, t, g, unknown or other
  misc_feature (291)..(291): n is a, c, g, or t
tcagcgcagtacgacacgaccggtgctcgatttagtatctgatagttgggtttggggggtccaggaggcagaactctgggtgtctcaccatggcctggatccctctcttctccccctcctcactctctgcacaggctctgaggcctcctatgagctgacacagccaccctcggtgtcagtcgtccccaggacagacggccaggatcacctgctcgtggagatgcattcgaccaaaaccgatatgactttagttggtaccagcagaagccggccacggcccctgtgttggtnatgtaataaagacactgagaggccctcgagggactcctgagcgtattctcgtcgctccgaggtcgaagggacacgggtcactagttcggaccagtcgagtagggacgtcccgagggacgaaggaacgggacgaggcgtagtaacttattacgtttggtaactaagttacaaacgacgtaaccaacctagtttaggttaactttagtacgttacgttacggaacgttacgaccggtaacgtaaacggtcctaccggttccgtcgggtacaccgacccgaacgaccccaacccgtactcgtacctacttcgtttaccccg

SEQ ID NO: 352377 - DNA, 616 bp, Homo sapiens
  misc_feature: GZ8MTXP02JWIGP.52.38.D05.1.454.CMB.2.raw
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
tcagcgcagtacgacacgaccggtgctcgatttagtatctgatagttgggtttgggggtccaggaggcagaactctgggtgtctcaccatggcctggatccctctcttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtataaagacactgagagccctnagggatccctgagcgattcnctggctcgaggtcagggacacgggtcacagttggcctatccaagtgggacgtacccgaggacaggaaggacggaggccgtaggtaacttattattggactaaatcaaacagaccaacctaagtttaggtaacctttaagtcgttacgtttacgggaaaacttcggaccgaaccgtaaacggggttaccaaaccccggttccttacgggggtaccaccggaaccccgaaaaccgggtaaccccaaacccccgaacgttaccgacccgtaacctttaccctttacccccgg

SEQ ID NO: 352378 - DNA, 739 bp, Homo sapiens
  misc_feature: GZ8MTXP02IZTXN.52.38.D05.1.454.CMB.2.raw
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggacagcagagcggcaggcccctgtgtggngntgtataaagacactgagacggcctcgagggactcccgtgacgccgtagttcctcgtggcttccgagggtcgaacgggggtacaaacgggtccaacgacgtttcgggacccaagtccgaaggttcggaacgtcccgaaagggccgaagggtacgggaaaccgggtacggtacgtacgtaaacgtttaagttttaacgttacggttaactaaaacgtaccgaaaaccgtaaccgtaaccgtaaaccgttaacgttttaacggtttaacttttaaacgttcggtttaaccggtttaaccgggtaaaccgttaccggggtaacccgtaaacccggttaaaccggggtttccccgtaaaccccgggtttccccggttaacggggtaacccgtaacccggtaacccccggtaaaacccgggtaacccccctaaaacccccgttaaccggttaccgttaacccg

SEQ ID NO: 352379 - DNA, 620 bp, Homo sapiens
  misc_feature: GZ8MTXP02IBKO1.52.38.D05.1.454.CMB.2.raw
  modified_base (297)..(297): a, c, t, g, unknown or other
  misc_feature (297)..(297): n is a, c, g, or t
  modified_base (489)..(489): a, c, t, g, unknown or other
  misc_feature (489)..(489): n is a, c, g, or t
  modified_base (609)..(609): a, c, t, g, unknown or other
  misc_feature (609)..(609): n is a, c, g, or t
tcagcgcagtacgacacgaccggtgctcgatttagtatctgatagttgggtttggggggtccaggaggcagaactctgggtgtctcaccatggcctggatccctctcttctccccctcctcactctctgcacaggctctgaggcctcctatgagctgacacagccaccctcggtgtcagtgtccccaggacagacggccaggatcacctgctctggagatgctattgaccaaaacgatatgcttattggaccagcagaagccgggccacggcccctgtgttggtgatgtaataaagnactgaagacggccctcgagggactccctgagcgattctcctgactccgaggtcgacggggacaccgggtcaacgtacgttcggccctaagtcgtaaagggtcggaaacggtaccccgaaggggccgaaagggaagggtaaccggaaggggctacgggaacctttagtttaaattcggttacaaattcaaaanacggtaacaccgtaatttcggtaattagttgtaccgttacggaaactcggaccgactaaacggtcacccgttcgtacgggccaacgcccgaaacggcccaaacccctacggcttaacccncttaccgtccg

SEQ ID NO: 352380 - DNA, 607 bp, Homo sapiens
  misc_feature: GZ8MTXP02IXFKO.52.38.D05.1.454.CMB.2.raw
  modified_base (228)..(228): a, c, t, g, unknown or other
  misc_feature (228)..(228): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
tcagcgcagtacgacacgaccggtgctcgatttagtatctgatagttgggtttgggggctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatccacctgctctgganatgcattgaccaaaccgatatgcttatggtaccagcagagccggcaggcccctgtgtggtnatgaataaagacangagacggccctagacgggactcccgtgacgtccgtattcgtctggtctccgagtcgaagggacaaacgggtcacgtgttacggcctagtcaggtgagtaccaagggacaggaacggacgaagggcctagtaaacttaagttattagtacaaacttacaaaacgaacgactaactaagtttacggtaactttacgtcgttacgttacggtaaacgtcgaaccgtaaaccgtaacggtaccgaacccgttcggtacggaacgaaccggacccgaaaccggacccctaaaccccgtacgtccgtacc

SEQ ID NO: 352381 - DNA, 707 bp, Homo sapiens
  misc_feature: GZ8MTXP02FW8EJ.52.38.D05.1.454.CMB.2.raw
  modified_base (241)..(241): a, c, t, g, unknown or other
  misc_feature (241)..(241): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgctattgaccaaacgntatgcttatggtaccagcagaagccggaccacggcccctgtgttggtgatagtataaagacacgtgaacgcggccctcgacgggacttcccgtagacgacgtacttccgtccgtgtccttacgacggtcggaacgggaccgaacgggtcaacgtacgtttcgggaccctaagtcgtaacgtgggacgtccgaagggacgaaggacgggacggaaggtcgtacggtaaacttacgtttaagttacggtaaccttaaacgtaaccgaaacaaacggtaaacctaacccgttaagtttacgggtttaacctttagttaccgttaacgtttacggaaaacgttcgaaccggtaaacgtaaaccggggtacctacccggttcccggttaggtacccgaaccggaaccccgtaaaaccggacccccctaaaacccccgttacgttcccggtaaccttaccgtttacccccgg

SEQ ID NO: 352382 - DNA, 715 bp, Homo sapiens
  misc_feature: GZ8MTXP02IBBXW.52.38.D05.1.454.CMB.2.raw
  modified_base (312)..(312): a, c, t, g, unknown or other
  misc_feature (312)..(312): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacacgccaccctggtgtcagtcgtcccaggacagcgccaggatcacctgctctggagatgctagtgacccaaacgatacgtgtcttattggtaccagacagaacggccggaccgacggccccttggtggtttggtgtagtagtaanaaagacagtagacgacggcctgagggactacccgtggacgccgtattccgtcgtcggccttccgacgggtcaacggggaacaaccgggtacacgtacggttcgacacgttcgaaggttcgacggtacccgaaggggacgaaagggacgggtaaccggagggtaccgtagtaaaccttttagtttaaagttacggtttacaaaagttacccaaaacgaacgtaaaacctaccggttaagtttacggtttaaacctttaagttcggttacgttttaaacgggaaaccgtttgggacccgtaaaccgtaaacgggttacccgtaaccgtttccggaccgggttaacccgaccgaaaccccggtacccgggaaaccccctacccccggtaacgtttcgtaacccccg

SEQ ID NO: 352383 - DNA, 547 bp, Homo sapiens
  misc_feature: GZ8MTXP02FJUQ4.52.38.D05.1.454.CMB.2.raw
  modified_base (239)..(239): a, c, t, g, unknown or other
  misc_feature (239)..(239): n is a, c, g, or t
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
  modified_base (368)..(368): a, c, t, g, unknown or other
  misc_feature (368)..(368): n is a, c, g, or t
  modified_base (410)..(410): a, c, t, g, unknown or other
  misc_feature (410)..(410): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgtggngatgtataaagacactgagaggccctanagggactccctgagcgtattccctcgtggctccgaggtcaggggacaacggtcanattgccatcagtgatcagcagagcgagctgactattatgtanaagtcaaacagacacctattaggtacttagtgtacgttcggaaacttgaccgaccgtaaagggtccaaccggttccgtagggtccaaggaaccccgaacgggaccccaaaccccagtaccgttaccaactttccccg

SEQ ID NO: 352384 - DNA, 609 bp, Homo sapiens
  misc_feature: GZ8MTXP02JUNKC.52.38.D05.1.454.CMB.2.raw
  modified_base (342)..(342): a, c, t, g, unknown or other
  misc_feature (342)..(342): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtccagtgtccccaggacagacggccaggactcacctgctctggagatgcattcgaccaaacgatatgcttatggtaccagcagaacgccggccaggccccgtgtcgttggtgatgtaataaagacacgtgacgacggccctagacgggtactccctggacnccggtattccgtctcggcctcgaggtcgaagggacaaaccggtcaaactgttcgccctaagccgtaaggtggacgtaccgaggaccaggaagggaaacgggtgactagtaacttatttacgtacgtaactaatacaaacaacgtaacctaacgtaagtttcggttaactttagtcgttacgtaccggaacttcggaccgtaaacgtacggtacctaccgtcgtggaaccgacgacccgaaacgacccctaacccgtacgtacctacg

SEQ ID NO: 352385 - DNA, 613 bp, Homo sapiens
  misc_feature: GZ8MTXP02FHTE9.52.38.D05.1.454.CMB.2.raw
  modified_base (295)..(295): a, c, t, g, unknown or other
  misc_feature (295)..(295): n is a, c, g, or t
  modified_base (477)..(477): a, c, t, g, unknown or other
  misc_feature (477)..(477): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctcgtggagatgcattcgacccaaaccgatatgcttattgtaccagcagaacgccggcacggcccctgtgttggngatgtaataaagacatgagaggccctagagggactccctagacgccgtattctcgtcggtctaccgaggtcgaaggggaacaaacgggtaccactagttcggacctagtaccgaggttggacgtcccgaaggcgaggacggacggaggacgtagtacttattagttcgtactaaatacaaanaccgacaacctagtttacggtaacttagttcgtacgttacggaactcggaccgtaaaccgtaacggtccgtaaccgtccgttacgggccgaaccgacccgaaaccggacccctaaaccccgacgtacgtaaccccg

SEQ ID NO: 352386 - DNA, 625 bp, Homo sapiens
  misc_feature: GZ8MTXP02F192J.52.38.D05.1.454.CMB.2.raw
  modified_base (227)..(227): a, c, t, g, unknown or other
  misc_feature (227)..(227): n is a, c, g, or t
  modified_base (476)..(476): a, c, t, g, unknown or other
  misc_feature (476)..(476): n is a, c, g, or t
  modified_base (507)..(507): a, c, t, g, unknown or other
  misc_feature (507)..(507): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgcattcgacccaaacgatatgtactttagttacggtaccagacgaaggaacggcccgggaccacggccccgtagtcggttggtagagtagtaataaacgactacgtagacggacggccctacggacgggacctccgtaggacgtacccgtaactttcctcgtcggtctaccggagggtccggaagggaaccgtaaacggtaccacgtagtcggacagtcgaggtgacgtcgaggacgaggaggacgnggactagaacttaatgtacgtacaatacaanaacgaccactagttacgtacttagtgtacgttacggtaactgaccgtaaaccgaacggtcgtacccgtcgtacggaaccgtaccgaccgtaacccgacctaaccccgatacgtacccg

SEQ ID NO: 352387 - DNA, 641 bp, Homo sapiens
  misc_feature: GZ8MTXP02JRNA6.52.38.D05.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgganatgcattgaccaaaccgntatgcttatgtaccagcagagccggcacggcccctgtgtggtgatgtaataaagactacgtagaggacggcccctacgacgggtactccccgtagacgccggtattcgtcgtggccttccgaggtcgaacgggacaaccggtcacgtagtttcgggaccctaagtccgaaggttcggaacgtcccgagggaccagggaaggaccggagggcctaggtaaccttagtttagttagtactaagtaccaaactaacgacctaacctaagtttcggtaacctttaagtcgttcgtttaaccggaaacttggaacccgaaaccgtaaacggtcccgtaaccggtcccgtacgggtaaccgaaccggaccccgaacggacccctaaccccgtacgtccgtaaccc

SEQ ID NO: 352388 - DNA, 572 bp, Homo sapiens
  misc_feature: GZ8MTXP02FPY7Z.52.38.D05.1.454.CMB.2.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (304)..(304): a, c, t, g, unknown or other
  misc_feature (304)..(304): n is a, c, g, or t
  modified_base (406)..(406): a, c, t, g, unknown or other
  misc_feature (406)..(406): n is a, c, g, or t
  modified_base (456)..(456): a, c, t, g, unknown or other
  misc_feature (456)..(456): n is a, c, g, or t
tcagcgcagtacgacacgaccggtgctcgatttagtatctgatagttgggtttgggggctgtgggtccaggaggcagaactctgggtgtctcaccatggcctggatccctctacttcctcccctcctcactctctgcacaggctctgaggcctcctatgagctgacacagcccaccctcggtgtcagtcgtccccgaggacagacggccaggatcacctgctctggganatgctattcgaccaaaaccgnttatgtacttagttcggtaccagcagaacgccggccacggcccctgtgttggtnatgtaataaagcactgagacggccctgagggactccgtgacgcgtattcgtgtcggctccgaggtcgaaggggactaacgggtcacgtagttcggacctaancgtaggtggacgtccgaggcagggaggacgaggctagtacttaattgttnactaatacgaacagacactagttacggtacttagtgtacttacggactgacgtaccgtaaggtcctaccgtcgtgggaaccacgacccgaacgaccccaaaccctcgtcgttaccc

SEQ ID NO: 352389 - DNA, 580 bp, Homo sapiens
  misc_feature: GZ8MTXP02FTWNF.52.38.D05.1.454.CMB.2.raw
  modified_base (241)..(241): a, c, t, g, unknown or other
  misc_feature (241)..(241): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtcccaggacagacggcaggatcacctgctctggagatgcattgaccaaacgntatgtcttatcggtacagacagaacgccggaccacggcccctgtgttggtgatagtaataagacacgtgagacggccctagagggactccgtagacgaccgtacttctgtcggtcctaccggtaggtccgaacgggaactaacgggtaccacgtagttcggacctagtcgaggtggacgtcgaggcaggaggacgagactagtaacttattagttagactaaatacaaacgacgaactaccgtagtttacggtaatttagtcgttacgttacgaacgtcgacgtaacgaacggtccaccgtcgtaggaacacggaccaacggcccaaccgtctcgtacc

SEQ ID NO: 352390 - DNA, 725 bp, Homo sapiens
  misc_feature: GZ8MTXP02J02P9.52.38.D05.1.454.CMB.2.raw
  modified_base (234)..(234): a, c, t, g, unknown or other
  misc_feature (234)..(234): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggcacggcccctgtgttggtgatgtaataaagacacgtgagacggccctgagggactcccgtgacgcgtacttctcgtggctcgaggtcgagggacaaacggtcacgtagttcggcctaagtcctaaggtcggtacgtcccgaaggggacccaagggaacggggaacggaacggtaccgttagggtaaacctttaagtttaaacgtttcggtaacctaaaacgttaccaaaaacgaccggtaaacctaaaccccgttaaggttttacgggtttaaacccgtttaagtttaccggtttaccgtttaacgggtaaaccgtttacgggacccggtaaacccgttaaaccggggttaccgtacccccggtttacccggttacgggggttacccgaaacccggtacccccggtaaaccggggacccccctaaaacccccggtacctttaccggtacccgtttaacccccg

SEQ ID NO: 352391 - DNA, 703 bp, Homo sapiens
  misc_feature: GZ8MTXP02JKJWE.52.38.D05.1.454.CMB.2.raw
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctggagatgctattcgaccaaacgatatgtcttatcggtaccagcagaacgccggcgacggcccctgtggttggtgatgtaataaagacacgtaggagacggccctacgagggtactcccgtagacgcgtacttccctcgtcggctccgacgggtacgaacggggaccgaaaccgggttcaaccgtagttcggaccctatccgtaagggtcggtacggtacccgaagggaccgaaggggaacggggacgggaaacgggtccgtacggtaactttaagtttaagtttacgtaacctaaacgttaacctaaaacgaacggtaaacctaaccgttaacgtttacggttaactttacgttacggttacgttaccgggtaaaacttcggaaccgtaaccggtaacggtacccgtacccggttccgtacgggtaccaccggaaccccgaaacggtaccccaaaccccgtacgttacgtacccttacgttccccg

SEQ ID NO: 352392 - DNA, 721 bp, Homo sapiens
  misc_feature: GZ8MTXP02F2QFJ.52.38.D05.1.454.CMB.2.raw
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgacctaaacgattatgtcttattcggtaccagcagaacggccggaccacggcccctgtgtggtgatagtaataaagacactggaacgacggcccctagacggggtacctcccgtaggacgtacgtacgtttccgtgtacggtacccgttcgaacgggtcgtacgggggtaaccgaaacgggttacaaacgttacgttccgggaacctacgtaccgtaggtacgggtacgtacccggaagggacgaaacgggacggggaccggtaacgggtacccgttaagggtaactttaaaggtttaattacggtaaccgtaaattacccgaaaacgacgtaaaccgtaaacctaagtttaacggttaactttaacgttcgttaccgtttaacggtaacgtacggtaccggtaaaccgtaaacgggttcctacccgttaccggtacgttaccgaacgaccccgtaaacggaccccctaaccccgaatttccgtactaacccg

SEQ ID NO: 352393 - DNA, 660 bp, Homo sapiens
  misc_feature: GZ8MTXP02GY9M4.52.38.D05.1.454.CMB.2.raw
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (277)..(277): a, c, t, g, unknown or other
  misc_feature (277)..(277): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacagccacctcggtgtcagtcgtcccaggacagacggcaggatcacctgctntggagatgctattcgaccaaacgntatgnttattgaccagcaagaagccggcacggccctgtgtggnatagtaataaagcacgtgaacggacggccctgacgggactcccgtaggacgtcgacttcgtcgtcggcttaccgacgggttacgacggggtaacaacgggttaccaacgtagttcgggaccctaagttaccgagggttacggtacgtacccgagggaaccgaaggacggaagtacgggacgtaacgactttaattaacgttggtacaaattacgaaacgacgaaccgtaacctagttaacggtaactttacgttagttaccgttacgggtaaaactcggtacgtaaaccgtaaacgggtccctaaaccggtcccgtttacggggaacaacccggaacccaaaccgggtaccccaaaacccggtactttacgcctttaaacccg

SEQ ID NO: 352394 - DNA, 715 bp, Homo sapiens
  misc_feature: GZ8MTXP02I4ZV5.52.38.D05.1.454.CMB.2.raw
  modified_base (223)..(223): a, c, t, g, unknown or other
  misc_feature (223)..(223): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgatatgcttattgtaccagcagaagccggcagccctgtgtgtgatgtataaagacacgtagagacgccctagacgggactcccgtgagtcgtattccgtcgtcggtactaccgaggtaccgaaggggaccgaaacgggttcaaacgtagttcgggaccagttacgaggtggacgtaccgagggcgaaggagggaccgagggtacctaggaccttaagtttacgtttacgtaactaaacttaccgaaaacgtaacggtaaaccaaccccgttaagtttacgggttaaaaccttttagtacggtttaccgtttaccggggaaaacctttcggaccggttaaaacccgtaaacggggttaccccgtaaacccgggtttcccggtaaccgggggttacccaaccgggtaaccccccgaaacgggggaacccccctaaaacccccttaacgttacccggtaccccgtaacgttttcccccg

SEQ ID NO: 352395 - DNA, 648 bp, Homo sapiens
  misc_feature: GZ8MTXP02G3OLG.52.38.D05.1.454.CMB.2.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctcgtgganatgctattcgacccaaaccgtatatgtctttaagtcggtaccagcaagaacgccggaccacggccctgtgtggtanatagtaataaacgacacgtaggaacggacggcccctaggaacgggtacctcccgtagacgacgtattccctacgcgtactaccggaggtacgaacgggacgtaaccggtcacgtagttcggactagtcgtaaggtggtaccgtcgaagggcgaaggagggaccgaggtcgtaagtacttaagtttattacgtaacaaactacgaaactacggtaaacctaaccgttagttaccggtaatttaagtcgtttaacgtacggaacttcggaaccgtaaacgtacgtaccgaccgttcgacggtaccaccgaaccgaaccgtacccaaccctgtacgtaccactttcccg

SEQ ID NO: 352396 - DNA, 573 bp, Homo sapiens
  misc_feature: GZ8MTXP02JPN51.52.38.D05.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtgtcagtcgccccaggacagacggccaggatcacctgctcgtgganatgctattcgaccaaaccgntatgtcttattcggtacagcagagccggcacggcccctgtgttggtagatagtaataaagacacgtagagacggccctacgacgggactccgtgagccgtacttcgtcgtggctacgagtcgacgggactaaccgggtcacgtagttcggacctatacgaggtgacgtcgaggacagnggaacggngtactagtaacttagttacgtagtaacactacaacacgaactacttagttacgttactagtcgtacgttacgacgacgacgacgtacgtaccgtaccgtcgtacggtaacgaccgtaaccgacgacccgacctacgtacgtc

SEQ ID NO: 352397 - DNA, 662 bp, Homo sapiens
  misc_feature: GZ8MTXP02F90WC.52.38.D05.1.454.CMB.2.raw
  modified_base (182)..(182): a, c, t, g, unknown or other
  misc_feature (182)..(182): n is a, c, g, or t
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
  modified_base (500)..(500): a, c, t, g, unknown or other
  misc_feature (500)..(500): n is a, c, g, or t
  modified_base (516)..(516): a, c, t, g, unknown or other
  misc_feature (516)..(516): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagcccaccctggtntcagtcgtccccaggacagcggccaggatcacctgctcgtggagntgctattcgaccaaacgntatgtctttatggtaaccngcaagaggcccggcacggcccctggtgttggtanatgtaataaagcaactggaacgacgggtcccctaaggacggtacctcccgtaggacgccgtatttccgacttcggggaccttcgagggtcccaaagggggtaccaaacgggttaccagtacgttcgggaccctagttccgaaaggttcggacgtccgaagacgaggacggacgtagtccaagtactttagttattcggtaanaccgttaagaacgaanaccgacttagtttacgtaacttgtacgttaccgttacgggaaacctaggtaccccgaaacgtaaacggttccccgtaaacgtcccggttacggtaaccgacccgacccggtaaaaccggccccaaaccgtacgttaaccgtccccg

SEQ ID NO: 352398 - DNA, 623 bp, Homo sapiens
  misc_feature: GZ8MTXP02IPO1O.52.38.D05.1.454.CMB.2.raw
  modified_base (176)..(176): a, c, t, g, unknown or other
  misc_feature (176)..(176): n is a, c, g, or t
  modified_base (239)..(239): a, c, t, g, unknown or other
  misc_feature (239)..(239): n is a, c, g, or t
  modified_base (285)..(285): a, c, t, g, unknown or other
  misc_feature (285)..(285): n is a, c, g, or t
  modified_base (485)..(485): a, c, t, g, unknown or other
  misc_feature (485)..(485): n is a, c, g, or t
tcagcgcagtacgacacgaccggtgctcgatttagtatctgatagttgggctgtgggtccaggaggcagaactctgggtgtctcaccatggcctggatccctctacttctccccctcctcactctctgcacaggctctgaggcctcctatgagctgacacacgcccaccctcggtntcagtgtccccaggacagacggccaggactcacctgctcgtggagatgcattcgaccaaacgntatgtcttatcggtaccagcagacgccggccacggccctgtgtggngtatgtaataaagacagtagagacggtccctagagggtactcccgtaggacgtcgtacttccgtacgtcgggtacctacgaggttacgacggggtaaccaaacgggttcaacgtagttacggacctatacgaagtcggacgcccgaggacaggaaggaacgagggtcctagaattattattagtactaataccaacgaanactaaccgtagtttacgttaacgttatcgttacttaggaaccttcggaccaaccgtaaaggtccctaaccggttccgtacggggaccaaccgaccccgaaaccggacccccaaaacccgtactaccgtactaaccccg

SEQ ID NO: 352399 - DNA, 529 bp, Homo sapiens
  misc_feature: GZ8MTXP02JQCH8.52.38.D05.1.454.CMB.2.raw
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
tcagcgcagtacgacacgaccggtgctcgatttagtatctgatagttgggtttgggggtgggtccaggaggcagaactctgggtgtctcaccatggcctggatccctctacttctccccatcctcactctctgcacaggctctgaggcctcctatgagctgacacagccaccctcggtgtcagtgtccccaggacagacggccaggatcacctgctctggagatgcattgaccaaaccgatangcttattggtaccagcagaagccgggccaggcccctgtcgttggtnatcgtaataagacatgagacggctcgaggactccgtgaacgcgtactcgctggctccaggcnggactaggcaacngttcgccgatacgngtgngcgagagagagacgagcgtgactatatagtatactacacacacgtactagtacgtacttagtacgtacgtacgtacgtacgtacgtacgacgtacgtaccgtacgtcgtcgaacgaccgaacgaccgtaccgtacgtacgtacgtcg

SEQ ID NO: 352400 - DNA, 703 bp, Homo sapiens
  misc_feature: GZ8MTXP02JMR6D.52.38.D05.1.454.CMB.2.raw
  modified_base (181)..(181): a, c, t, g, unknown or other
  misc_feature (181)..(181): n is a, c, g, or t
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagcgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctggtntcagtcgtccccaggacagacggccaggatcacctgctctgganatgctattcgaccaaaccgtntactgtcttagtgtaccagcagacgccggcacggccctgtgttgtgatagtaataagactagtgacgacggtccctagacgggtactcccgtaggacgcccgtattcgtcgttacggcctaccggtaggtaccggacggggaaccgtaaccggttaccgaacgtcgttacgggacctaaacgtccgtaagggttacggtaaccggtcccgaagggaccgaaggggacggtaaccggtagggaccgttaacggtaactttagtttaaaggtcgttaacgaacgttacgaaaacgtacgaaaccttaccgttaagtttacggttaacctttagtcgtttaccgttacgttaaacgttcgaaaccggtaccgtaacggtaccgtacccgttaccggttcgggtaaccacccgtaacccggtaacccggacccccgtaaacccgtccgttaccgtaacccg

SEQ ID NO: 352401 - DNA, 543 bp, Homo sapiens
  misc_feature: GZ8MTXP02JYM71.52.38.D05.1.454.CMB.2.raw
  modified_base (143)..(143): a, c, t, g, unknown or other
  misc_feature (143)..(143): n is a, c, g, or t
  modified_base (180)..(180): a, c, t, g, unknown or other
  misc_feature (180)..(180): n is a, c, g, or t
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctcngttaggcctcctatgagctgacacagccaccctggtntcagtgtcccaggacagacgccaggatcacctgctctgganatgctatcgaccaaacgntatgtactatgtacngcagagccggcaggccctgtgtgngatgtaataaanacactgaacgacggccctagaggactcccgtagacgcgtactttcgcgtggacctaccgtaggtaccgaagggaccaacgggtacaacgtacgttaggaccctatccgagttacggacgtaccgagacgagtacggacgaggctagatattatgaananananananacatatatatagtacgtacgactacgacgacgacgtacgtacgtacgtacgacgacgaaccgacgaccaccacctactactactcg

SEQ ID NO: 352402 - DNA, 662 bp, Homo sapiens
  misc_feature: GZ8MTXP02FPZEX.52.38.D05.1.454.CMB.2.raw
  modified_base (224)..(224): a, c, t, g, unknown or other
  misc_feature (224)..(224): n is a, c, g, or t
  modified_base (293)..(293): a, c, t, g, unknown or other
  misc_feature (293)..(293): n is a, c, g, or t
tcagcgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgctattcgaccaaacgatatgtacttatggtaccagcagaacgccgggaccacggccctgtgttggngatgtaataaagacagtggaagacggcccctagacgggacttccccgtaggacgcggtactttcccgtacgtcggccttaccgagggtaccgaaggggacctaaacgggtcaaacgtagttcgggacctagttaccgagggtcggaacgtcccgaaggacaagggacggaccggaggccgtagaaacttagtttacgttggaactaaatacgaaacgacgtaaacctaaccgtagtttacggttaactttagtacgttaccgttacgggaactcggacccgaaacgtacgggtcccaacgttccggtacgggtaccaacggaacccgaacggtaccccaaacccgtactacgtaccctacgtttacccg

SEQ ID NO: 352403 - DNA, 264 bp, Homo sapiens
  misc_feature: GZ8MTXP01ER5C4.22.66.F11.1.454.CMB.2.raw
  modified_base (263)..(264): a, c, t, g, unknown or other
  misc_feature (263)..(264): n is a, c, g, or t
tcagacatacgcgtcacgaccggtgctcgatttagtcacgcgagaagggccggggcagagcggtggctactggggcttcttccccatggacgtctggggcaaagggaccacgatcatcgtctcctcagcctccaccaagggcccatcggtcttccccctggcaccctcctccaagagcacctctgggggcacagcggccctgggctgcctggtcaaggactacttccacgcgtatgtctgagcgggctggcaaggcgcatagnn

SEQ ID NO: 352404 - DNA, 262 bp, Homo sapiens
  misc_feature: GZ8MTXP02GJX81.22.66.F11.1.454.CMB.2.raw
  modified_base (260)..(262): a, c, t, g, unknown or other
  misc_feature (260)..(262): n is a, c, g, or t
tcagacatacgcgtcacgaccggtgctcgatttagtcacgcgagaagggccggggcagagcggtggctactggggcttcttcccatggacgtctggggcaaagggaccacgatcatcgtctcctcagcctccaccaagggcccatcggtcttcccctggcaccctcctccaagagcacctctggggcacagcggccctgggctgcctggtcaaggactacttccacgcgtatgtctgagcgggctggcaaggcgcatagnnn

SEQ ID NO: 352405 - DNA, 646 bp, Homo sapiens
  misc_feature: GZ8MTXP01EUPH1.25.2.A02.1.454.CMB.2.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagcccaccctcagcgtcgtcgggaccccccggnagacggtccaccctctcttgttctggaancagcctccgacgtacggaaattagtttgtctactggtaccagcagcctacccgaagaaacccggcccccaaagcctcctcatctataggaatgatcagccgccctgaggactaccgtgaccgtacttcctcgtcggcctacggaaaacgttcgtcggtccctcccgtccgggcccctccccgtcgggccctagtccgtaggtcggggcccgttcccgggtccggagggtagtggaacggtctagaattacttacgtgtacggcgttagggtttgggactggccctaggtcgtaggtacggttcgggtccggtacgggttcggttccggggcgggaacgggtacccaaggtccgtcgaaccccggttcgttagggtccacgtcccgacggccttccgtcccccgttcggtaaccc

SEQ ID NO: 352406 - DNA, 632 bp, Homo sapiens
  misc_feature: GZ8MTXP01D06QV.25.2.A02.1.454.CMB.2.raw
  modified_base (225)..(225): a, c, t, g, unknown or other
  misc_feature (225)..(225): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtgctgactcagcccaccctcggtgtctgaacgcccccaggcagaggtcacatctcctgtctgancagctaccaacgtcgagataatgctagtaaactgtaaccagcgaggtacccgaagggaacgcctacccaaactcctacattactaattatgatgatctcgctcgcccgtccgacggggtctcgtcgacccgtaacttccgtcgtcggcccttacctaacgtccgtacggcctacccgtcaccgtccctcccgtgcccagtcccgaggtcggtacctcagtctaggagtaggtcggaaggtcttagtaatttacgttacgtgtacgctacgagtaggtgggtaattcggaacgtacggttccgttaagggtaagggtttgggggtttcggggttacgggttccgggggaacgggtaaccgggtaaacccgttagggcccgttaacgggttaaccccggtttaacccgg

SEQ ID NO: 352407 - DNA, 609 bp, Homo sapiens
  misc_feature: GZ8MTXP01EYUSH.25.2.A02.1.454.CMB.2.raw
  modified_base (499)..(499): a, c, t, g, unknown or other
  misc_feature (499)..(499): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagcccaccctcagcgtcgtcgggacccccggcagacggtccaccctctcttgttctggaagcagctaccaatatacggaactaacactgtagaactggtaccagcaagactcccgaaggaaactcggaccccctaaatttctacatttatagtattatcagccgaccctcgacgggtccctgaccgtattcctcgtggcctaccgaagttctacggctaccctcacgtccccttccccgtgggacccctagtcgtaggtcggggtacccagtacgtggaaggatggaggtctgtaccttattacgtggcgcgagcgagtgggatggacngtcctaggatgggttggttgggttttcgggacgggaaggggaccggtaagttcgttcggacccggttccgtagggtcacggacccgaagggtcccttccggtccccccgg

SEQ ID NO: 352408 - DNA, 522 bp, Homo sapiens
  misc_feature: GZ8MTXP01DLF99.25.2.A02.1.454.CMB.2.raw
  modified_base (199)..(199): a, c, t, g, unknown or other
  misc_feature (199)..(199): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggnagacggtcaccctctcttgtctggaagcagctccaatatcggaactaacactgtgaactggtaccagcaggtcccaggaatcggcccccaaattctcatttatagtagtatcagcgaccctnaggggtccctgaccgattctcctggctccaagtctaggcnccctcacgccctcccctggccatcagtgggtccagtctgagatgaggctgcttatactgcgcagcagtgggatgacagctgaagtggtgtggtttcggcgggtagggacgaaagcttggccgttccgtaagggtcaagccccaaggcctcgcccccgtcgg

SEQ ID NO: 352409 - DNA, 588 bp, Homo sapiens
  misc_feature: GZ8MTXP01CTHT7.25.2.A02.1.454.CMB.2.raw
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (311)..(311): a, c, t, g, unknown or other
  misc_feature (311)..(311): n is a, c, g, or t
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
  modified_base (499)..(499): a, c, t, g, unknown or other
  misc_feature (499)..(499): n is a, c, g, or t
  modified_base (580)..(580): a, c, t, g, unknown or other
  misc_feature (580)..(580): n is a, c, g, or t
tcagactgtacagtcacgaccggtgctcgatttagactcatctacaggggagctctgagagcggagccccagccccagaattcccaggtgttttcatttggtgatcagcactgaacacagaggactcaccatggagtttgggctgagcttgggttttccttgttgttatttttccaggtgtccagagtgaggtgcaggttggtggagtcgtggggggagcttggtccagcctgggagggtccgtgagngtctcctgtgcagcctntggattcatcttcagtcgacccactacagttggacctggggtcccnccagggcctaccggagggggaaggggctagggagtggggttgccgtaattagaaataacgctaagngtacacaacagaactcgccgngtctgagaaaggcagtattcattanctagaagagtatgaacttanaaagtaactcacgttgtaactctagacaaatcgaaacacgacctaagaaacccggnggaccgtaacgggtcttagtacttacgtgtgttacgttaggttacgaagacgttcgggtactaccttaccttaaccccttntttaaccc

SEQ ID NO: 352410 - DNA, 580 bp, Homo sapiens
  misc_feature: GZ8MTXP01CIKSQ.25.2.A02.1.454.CMB.2.raw
  modified_base (442)..(442): a, c, t, g, unknown or other
  misc_feature (442)..(442): n is a, c, g, or t
tcagactgtacagtcacgaccggtgctcgatttagactcatctacaggggagctctgagagcggagccccagccccagaattcccaggtgttttcatttggtgatcagcactgaacacagaggactcaccatggagtttgggctgagctgggttttccttgttgttattttccaggtgtccagagtgaggtgcagttggtggagtcgtgggggaggcttggtccagcctgggagggtccgtgagagtctcctgtgcagcctctggattcatcttcagtcgaccactacatggactgggtccgccaggctccgagggagggctgggagtgggttgcgtatagaaataagctaagagtacaccaaacagaatacgccgcgtcagtgaaaggcagattcattatctcaagagatagattacaaaagactacactgtaatcgtaanaactaaagtacgaaacacgaccgtaaacggaaaaccgacgggaaccgaacgggtcgttagttaacgttacgttggtcgttacgttacggacgtaaggtaccgtaacgggtactaccttaccctaacccttaattaacc

SEQ ID NO: 352411 - DNA, 544 bp, Homo sapiens
  misc_feature: GZ8MTXP01EJ4IE.25.2.A02.1.454.CMB.2.raw
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (368)..(368): a, c, t, g, unknown or other
  misc_feature (368)..(368): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
tcagactgtacagtcacgaccggtgctcgatttagactcatctacaggggagttctgagagcggagccccagccccagaattcccaggtgttttcatttggtgatcagcactgaacacagaggactcaccatggagtttgggctgagcttgggttttccttgttgttatttttccaggtgtccagagtgaggtgcagttggtggagtcgtgggggagcttggtccagccgtggagggtccgtgagngtctctgtgcagcctntggattcatctcagtgaccatacatggactgggccncaggctccgagggagggctggagtgggtgcgtatagaaataagctaagagtacacacaagaataacgcgngtctgtagaaaggcagtattcattanctanananatatatanaanaactactatagtatatananaanaagaacacgacaacgaaacgaacgacgacggtaacgtagttatacttgtgtagttagttcgacgtaacgtacgtaacgtactaccttaacccttaacttaacctaacc

SEQ ID NO: 352412 - DNA, 708 bp, Homo sapiens
  misc_feature: GZ8MTXP01A79R4.25.2.A02.1.454.CMB.2.raw
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (306)..(306): a, c, t, g, unknown or other
  misc_feature (306)..(306): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtgctgactcagccaccctcggtgtctgaacgcccccaggcagaggtcaccatctcctgttcnggaancagctccaacgtcggagataatgctagaaactggtaccagcacggtcccgagggaacggcctaccccaaactccctanacttctattatgatgtatctgctcgccctcgacggggtctcgtagacccgtaatttcctcgtcggtcctaccgtaaacgttccgtcgggtaccaaccccgttccaacgtcccccgttcccccgtcgggtacccctaacgttcccgtaacgggtttccggggccttaccccgaagtcccgttaggaacgggtagtgggtaacggtccgttaggtaactttagttaacgttgttacgggaccaggtacgtagttagggggaattacggaacccgtaggttacccgttagggtaaacgggtttgggggtttcgggggttcggggtttaacccgggggaacggggttaaccgggggaaacccggttaaacgggcccgttaaccgggaaaccccggtttccccgggg

SEQ ID NO: 352413 - DNA, 629 bp, Homo sapiens
  misc_feature: GZ8MTXP01BKXKZ.25.2.A02.1.454.CMB.2.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagcccaccctcagcgtcgtcgggacccccggnagacggtcaccctctcttgttctggaancagctccaatatacggaactaacactgtagaactggtaccagcaggtcccaggaactcggaccccctaaattctactatttatagtagttatcagccgaccctcgacggggtcctgaccgtattctctcggctccgaagtctacggccaacccgtcaccgtccctcccgtcggcctactcgaggttcgggtccacgtcgtggaggagttggacggtcgtggtactttacgttacgttcgccggtcgtacggccgtaggttgggaagttcggaacgacggtccgtaggtaagttgggttgggtttcgggttttcgggacggggtagggacgaacggtcgttacggccgttcgtaacggtcgaacggcccgaggttcccgtccggttccccgttaacccgg

SEQ ID NO: 352414 - DNA, 664 bp, Homo sapiens
  misc_feature: GZ8MTXP01BJ8KF.25.2.A02.1.454.CMB.2.raw
  modified_base (202)..(202): a, c, t, g, unknown or other
  misc_feature (202)..(202): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagcccaccctcagcgtcgtcgggacccccggnagaccgtcaccctctcttgttctggaagcagctaccaatatacggaactaaacactgtagaactggtaccagcacggtcccaggactccggaccccctaaattctactatttatagttattatcacgcgaccctgacgggtccngaccgtattcncgtcggctaccaagtcgtacgcctaactcgtacgtcccctcccgtcgggacccagtaccgtaggtcggggtacctagtcgtaggaggtagtaggcgtcgtagtctttaaagttcgttcggccggtacgaggacgtaggttacgggattaggaacgacggtaccgtaggttaagttggggttcggtttggggttttcggggacgggggtaacggggacggtaaacggtccgttacgggttacccgttaccggttaaggtcccgaaccggtacccggacggccccgttcccggttcccccggtttccgg

SEQ ID NO: 352415 - DNA, 706 bp, Homo sapiens
  misc_feature: GZ8MTXP01DKWWW.25.2.A02.1.454.CMB.2.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
tcagactgtacagtcacgaccggtgctcgatttagactcatctacaggggagcttcagctgtgggtagagaagacaggattcaggacaatctccagcatggccggcctccctctcctcctcaccctcctcactcactgtgcgagggtcctgggcccagtctgtgctgactcagccaccctcagtcgtcgtcggggacccccggnaggacgggtctcctattcttcttggttcgtggggaacncagtcctaccggtacggtaacggtaaatttaaggtttgtactacgtcggtaaccagacacggccctacccgaacggaaaacccggcccccaaagccttccctacatactaagtaacggtaatgactcgaacggtccggacccttacgaacgggtactaccgtacggaaccccgtacttcgtcgtcgacgtacgtaacgtcgacgtcctcccgtcgtaccctccgtcgaccagtcgagggtcgcgtccggtcgaggtatcggaggtacagtaattaagttcgttggggtcgtagttaggttagggctcgaccgtgttcgtcggtaggttccggtacgggtaggtttcgggtacgggaccggggtaaagggaccaaacggtccggttcggttaacccggttccggttaacggtaccaaccgggtacccggaaacggttcccgtccccggttccccgttaacccggg

SEQ ID NO: 352416 - DNA, 521 bp, Homo sapiens
  misc_feature: GZ8MTXP02G49AZ.25.2.A02.1.454.CMB.2.raw
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
  modified_base (430)..(430): a, c, t, g, unknown or other
  misc_feature (430)..(430): n is a, c, g, or t
  modified_base (478)..(478): a, c, t, g, unknown or other
  misc_feature (478)..(478): n is a, c, g, or t
tcagactgtacagtcacgaccggtgctcgatttagactcatctacaggggagctctgagagcggagccccagccccagaattcccaggtgttttcatttggtgatcagcactgaacacagaggactcaccatggagtttgggctgagctgggttttccttgttgttattttccaggtgtccagagtgaggtgcagttggtggagtcgtgggggaggcttggtccagccgtggagggtccgtgagagtctcctgtgcagcctctggattcatcttcagtgaccactacatggactgggtccnccaggctccgagggagggctgggagtgggtgcgtatagaaataagctaagagtacacacagatacgcgcgtntgtagaaaggcagattcattatctacaaagagatgaattacaaagaactcactgtanctagacaaatgaacagactagaaaaccgagacacggcgtagtactacngtcgactaggcaagactacggtcacctactaacccctattacc

SEQ ID NO: 352417 - DNA, 504 bp, Homo sapiens
  misc_feature: GZ8MTXP02FW87E.25.2.A02.1.454.CMB.2.raw
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
tcagactgtacagtcacgaccggtgctcgatttagactcatctacagggagcttcagctgtgggtagagaagacaggactcaggacaatctccagcatggccagcttccctctcctcctcaccctcctcactcactgtgcagggtcctgggcccagtctgtgctgactcagtgtctgggaccccggnagaggtctccatctcttgttctgggancagctccgacgtcggaaataagtttgctactggtaccagcagctcccagaaacggcccccaagctcctcatctataggaatgatcagcggcccctcagggatacctgaccgattctcctggctcgaagtctggctcctcggcctccctgccatcagtgggctccggtccgaggatgaggctgaatatacngtgnagtttggatgccagtctgagtggtccgacggtgttcggcggagggaccaaagctgaccgtcctaggtcagcccaaggctcgccccctcggtcactc

SEQ ID NO: 352418 - DNA, 519 bp, Homo sapiens
  misc_feature: GZ8MTXP02JERV3.25.2.A02.1.454.CMB.2.raw
  modified_base (199)..(199): a, c, t, g, unknown or other
  misc_feature (199)..(199): n is a, c, g, or t
  modified_base (359)..(359): a, c, t, g, unknown or other
  misc_feature (359)..(359): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggnagacggtcaccctctcttgttctggaagcagctccaatatcggaactaacactgtgaactggtaccagcaggtcccaggaatcggcccccaaacttctcatttatagtagttatcagcgaccctcaggggtccctgaccgattctctgctcagtctggcnctcacgcctccctgccatcagtggggtccagtcgtgaggatgagctgcttatactgcgcagcagtgggatgacagctgaatggtgtcgggttttcggcgggagggtacgaacgcgtcgaccgtcgtaaggtcgacgcccgaaggcctacgccccgttcgg

SEQ ID NO: 352419 - DNA, 527 bp, Homo sapiens
  misc_feature: GZ8MTXP02FTSWB.25.2.A02.1.454.CMB.2.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggnagacggtcaccctctcttgttctggaagcagctccgacgtcggaaattagtttgtctactggtaccagcagctcccagaaaccggcccccaagctccncatctataggaatgatcagcgccctnagggatacctgaccgattcctctggctcgaagttctggctcccgtcggccctcccgtggccatcagtcggctccggtccgaggatgaggctgaaatattactgtgctaggtttggattgccagtctgagtggtcgacggtgttcgggcggagggaccaaggcgtcgaccgtcgtaggtcacgccaaggcctcgccccctggtcc

SEQ ID NO: 352420 - DNA, 601 bp, Homo sapiens
  misc_feature: GZ8MTXP02GU210.25.2.A02.1.454.CMB.2.raw
  modified_base (381)..(381): a, c, t, g, unknown or other
  misc_feature (381)..(381): n is a, c, g, or t
  modified_base (412)..(412): a, c, t, g, unknown or other
  misc_feature (412)..(412): n is a, c, g, or t
  modified_base (489)..(489): a, c, t, g, unknown or other
  misc_feature (489)..(489): n is a, c, g, or t
tcagactgtacagtcacgaccggtgctcgatttagactcatctacaggggagctctgagagcggagccccagccccagaattcccaggtgttttcatttggtgatcagcactgaacacagaggactcaccatggagtttgggctgagctgggttttccttgttgttattttccaggtgtccagagtgaggtgcagttggtggagtcgtgggggaggcttgggtccagcctgggagggtccgtgagagtctcctgtgcagcctctggattcatcttcagtgaccactacatggactcgggtccgccaggcctccgaggggaaggggctgggagtggggtgcgtatagaaataagctaagagtaacacaacagactacgccgngtctagtagaaagcagtattcaattatctanaagagatacgtaattacaaaagtaactcactattatactagacaaaatagaaacacgaccgtaacggaaaaaccggngaaaccgaacgggtacccggttaagttaaccgttacgtacgtgtaccgtttagggacaaggtaacccgtacggggtacaacccttacccttaaaccccgttaatttaacccc

SEQ ID NO: 352421 - DNA, 531 bp, Homo sapiens
  misc_feature: GZ8MTXP02GO9V5.25.2.A02.1.454.CMB.2.raw
  modified_base (200)..(200): a, c, t, g, unknown or other
  misc_feature (200)..(200): n is a, c, g, or t
  modified_base (305)..(305): a, c, t, g, unknown or other
  misc_feature (305)..(305): n is a, c, g, or t
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtctcgggacccccggnagacggtcaccctctcttgtctggaagcagctccaatatcggaactaacactgtgaactggtaccagcaggtcccaggaatcggacccccaaatttcacatttanagtagttatcagcgaccctcaggggtcccctagaccgattctcctggctcaagtctggcacctcagccctcctgccatcagtgggtccagtctgagatgaggntgcttatacctgcgcagcagtggatnacagccttgaatgggtgttcgggtttcggcgggagggacgaacgtcgtacgaccgtccgtaaggtcacgacccgaaggcctccggacccccgttcgg

SEQ ID NO: 352422 - DNA, 606 bp, Homo sapiens
  misc_feature: GZ8MTXP02HTLG3.25.2.A02.1.454.CMB.2.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcgagggtccgtgggcccagtctgtggtgactcagccaccctcagcgtcgtcggggacccccggnagacggtcaccctctcttgttctggaagcagctaccaatatacggaactaacatgtagaactggtaccagcaggtcccaggaatcggacccccaaattcacatttanagtagttatcagccgtaccctgacgggtcccngaccgtattctcctgcctccaagttctacggacctacccgtcacctcccgtcccgtccgacgtactacgtacgtcggtcgtacgtcgtagagtagtagagtacgtacgtacgttacgttacgtcgtcgacgagacgagtaggtagagacgtacgtacgtagtagtaggttggttcgggttacgggtacgggacgggtaacggtaacgtacgtacgtaccgtacgtaacgtacgacgaccgacgtaccgtaccgtacccgtccg

SEQ ID NO: 352423 - DNA, 610 bp, Homo sapiens
  misc_feature: GZ8MTXP02GI29G.25.2.A02.1.454.CMB.2.raw
  modified_base (228)..(228): a, c, t, g, unknown or other
  misc_feature (228)..(228): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtctcgggacccccggcagagggtctccatctcttgttctgggancagctccgacgtcggaaattagttgtctactggtaccagcagctcccagaaaccgcccccaagcctcctcatctataggaatgatcagccggcctcgagggactacctgaccccgtattctcgtggctcgaagtctggcctccgtcggccctcccgtggcccatcgaggtcggccgtccgggtcccgaggactggaggtcgtagaattattacgtgtcgtcgtaggtttgggattgtcgtagttcgtggaggttcggtccggacgggtttcggttaccggggacgggtaaacggggtaaccgaacgggtccgtaacggtcccggttaccgtaacgggttaccacggtaccccgaagggtcccctccggtccccccgttcggg

SEQ ID NO: 352424 - DNA, 539 bp, Homo sapiens
  misc_feature: GZ8MTXP02GQDKB.25.2.A02.1.454.CMB.2.raw
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtctcgggacccccggcagacggtcaccctctcttgttctggaagcagctccaatatcggaactaacactgtgaactggtaccagcaggtcccaggaatcggacccccaaattcnctatttatagtagttatcagccgaccctgacgggtccctgaccgtnttcncctgctccagtctgcncctcacgccctccctgccatcgagtcgggtccagtcgtggagtatggagtcgtgtacttattactgcgtcgngctaggtggatgacngctagagtggtggttcggttcgggcggacgggacgacgtcgtacgtaccgtcgtaaggtccacggaccgacggtcctccgccccgtcg

SEQ ID NO: 352425 - DNA, 539 bp, Homo sapiens
  misc_feature: GZ8MTXP02H68XN.25.2.A02.1.454.CMB.2.raw
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
tcagactgtacagtcacgaccggtgctcgatttagactcatctacaggggagctctgagagcggagccccagccccagaattcccaggtgttttcatttggtgatcagcactgaacacagaggactcaccatggagtttgggctgagcgtgggttttcctgttgttattttccaggtgtccagagtgaggtgcagttggtggagtctgggggaggcttggtccagcctggagggtccgtgagagtctcctgtgcagcctntggattcatcttcagtnaccactacatggactgggtccnccaggctccgagggagggctgggagtgggtgcgtatagaaataagctaagagtacacacagatacgccgngtctgtgaaaaggcaagatcattatctnaaagagatgaattacaaaagaactactactatatatananaananaacacgacgaacgaaacgaacgacgacggacgtagtactactagtacgtacgtagtacgaagacgtacgtacgtacctacctaacccttaacttacc

SEQ ID NO: 352426 - DNA, 600 bp, Homo sapiens
  misc_feature: GZ8MTXP02JCF8R.25.2.A02.1.454.CMB.2.raw
  modified_base (403)..(403): a, c, t, g, unknown or other
  misc_feature (403)..(403): n is a, c, g, or t
tcagactgtacagtcacgaccggtgctcgatttagactcatctacaggggagctctgagagcggagccccagccccagaattcccaggtgttttcatttggtgatcagcactgaacacagaggactcaccatggagtttgggctgagctgggttttccttgttgttattttccaggtgtccagagtgaggtgcagttggtggagtcgtgggggaggcttggtccagcctggagggtccgtgagagtctctgtgcagcctctggattcatcttcagtgaccactacatggactgggtccgcaggcctccgaggggaggggctgggagtgggtggcgtatagaaataagctaagagtacacagagatcgcgcgtctgtagaaagcagattcattatctagaaagngaatgaattacaaaagtaacttccaagttagttactacttacggaactaaaagtacgaaactacgtaccgtaaacggaaaaacccgtggaaccgtaccgggtaccgttagttaacgttacgtgggtacgacgttacgggtaccaaggtaaccgttacgggtacgtacccttacctttaaaccccctaatttaacccc

SEQ ID NO: 352427 - DNA, 765 bp, Homo sapiens
  misc_feature: GZ8MTXP02GR7J7.25.2.A02.1.454.CMB.2.raw
  modified_base (229)..(229): a, c, t, g, unknown or other
  misc_feature (229)..(229): n is a, c, g, or t
  modified_base (364)..(364): a, c, t, g, unknown or other
  misc_feature (364)..(364): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtcgtcgggacccccggcagacggtcaccctctcttgttctggaancagctccaatagtcggaaactaacactgtgaactggtaccagcacggtcccaaggaactcggacccccaaattctactatttatagtagtttatcgacgccgaccctcgacggggttccctagaccgtatttccnccgtcggcctaccaaggttctcggcctacccgtccacggtccccttccccgtcgggccctaacgttccgtacggggttcgggggtaccctaagggttcccgtagggaacggggtagttacggggaacgggtccgttacgggtaccctttaagtttaccgttcggtaccggaccgtaagggacctaagggtaggggtaaacttcgggaaacgacggtacccgttaggtaaacggtttgggggtttacgggttttgggggttttacccggggagggggttaacgggggaaaccggtaaacggtccggtaccgggttaccccggttacggtaaccgggggttacccaaccggggtacccccgaaacggggtccccgttaccccggtacccccccggtttaccgg

SEQ ID NO: 352428 - DNA, 584 bp, Homo sapiens
  misc_feature: GZ8MTXP02G7V3G.25.2.A02.1.454.CMB.2.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctggcccagtctgtggtgactcagcccaccctcagcgtctcgggaccccccggnagaccggtcaccctctcttgttctggaancagctccaatntcgaactacactgtgaactggtaccagcaggtcccaaggaactcggaccccctaaacttctcatttatagtagttatcagccgaccctcgacggggtcccngtaccgtattccnctcggctacaagtctggcctaccgtcacgtccctccgtcggaccattccgaggtcgggtaccctagtcgtgaggtatggaggtctgtaccttagttacncgngacngngagtagagagagacgacgtagtagtggttggttcgggttcgggtacgggacgggacggacggtacgtacgtaccggtacgtaacggtacgacgaccgaccgtaccgtaccgtccccgtccg

SEQ ID NO: 352429 - DNA, 553 bp, Homo sapiens
  misc_feature: GZ8MTXP02GQNKT.25.2.A02.1.454.CMB.2.raw
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
tcagactgtacagtcacgaccggtgctcgatttagactcatctacaggggagctctgagagcggagccccagccccagaattcccaggtgttttcatttggtgatcagcactgaacacagaggactcaccatggagtttgggctgagcgtggtttctgttgttattttccaggtgtcagagtgaggtgcagttggtggagtcgtgggggagcttggtccagcctggagggtcctgagngtctctgtgcagcctnggattcatcttcagtnaccatacatggactgggtccgcaggctccgaggggagggctgggagtgggtgcgtatagaaataacgctaagagtacaccanagtactcgccgngtctagtgaaaaggctaagtattctattactcgtaaanaagagatagtatanaaagtaactactactatatatananaatacgacacgacgaacgaacgaacgaacgacggtacgtacgtacgttacgtacgtacgtacgtacgtacgaacgtacgtacggtacgtaccgtaccttaacccttacttac

SEQ ID NO: 352430 - DNA, 706 bp, Homo sapiens
  misc_feature: GZ8MTXP02IWWO8.25.2.A02.1.454.CMB.2.raw
  modified_base (249)..(249): a, c, t, g, unknown or other
  misc_feature (249)..(249): n is a, c, g, or t
  modified_base (400)..(400): a, c, t, g, unknown or other
  misc_feature (400)..(400): n is a, c, g, or t
tcagactgtacagtcacgaccggtgctcgatttagactcatctacaggggagctctgagagcggagccccagccccagaattcccaggtgttttcatttggtgatcagcactgaacacagaggactcaccatggagtttgggctgagcttgggtttttccttgtttgtttattttccaggtgtccagagtgaggtgcagttggtggagtcgtgggggagtcttggtccagcctgggagggtccgtgagngtctctgtgcagcctctggattcatcttcagtcgacctactacagtcggacgtgggtcccgccgaggcctacccggaggggaggggctgggaggttgggttcggaccgttataaagaaaataacgacgtaaagtacgttaaccaaccgaanaagaacgtccgcccgtacgttcgtaggtaaggaaacgggctaaagtatttaccaatttaagtcccttaagaaaagtagtaattaccgtaaattaaccgaaaaacggtaaaccttcctaaacgttagtttaacgtacctaggtaaaaccaaaagtttcgaaaacgaccgtaaccgttaaacggaaaaccgggacggaaacccgtacgggtcccgtttaggtaacctttagtcggagtacgtttacgggactaacggaccgtttacgggacctaaccttacccccggtttaaaccctaattttacccc

SEQ ID NO: 352431 - DNA, 572 bp, Homo sapiens
  misc_feature: GZ8MTXP02IMLRO.25.2.A02.1.454.CMB.2.raw
  modified_base (177)..(177): a, c, t, g, unknown or other
  misc_feature (177)..(177): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (410)..(410): a, c, t, g, unknown or other
  misc_feature (410)..(410): n is a, c, g, or t
  modified_base (505)..(505): a, c, t, g, unknown or other
  misc_feature (505)..(505): n is a, c, g, or t
tcagactgtacagtcacgaccggtgctcgatttagactcatctacaggggagctctgagagcggagccccagccccagaattcccaggtgttttcatttggtgatcagcactgaacacagaggactcaccatggagtttgggctgagctgggttttcctgttgttattttccaggtntccagagtgaggtgcagttggtggagtcgtgggggagcttggtccagcctgggagggtccgtgagngtctctgtgcagcctnggattcatcttcagtgaccactacatggactgggtccgccgaggcctccgaggggaagggctgggaggtgggtggccgtattaagaaataagctaagacgttaacacaacagactacgccgcgtctaggtacgaaaggcagtatacattanctacaagagatcgattacaaagactacactagtatctagactaaatgaaacagacctaagaaaaccgtgacaacggtccgtagtactttaaacgngtacgacgttacggacgtaacgacgtaccgggtcaaccctaccgtttaaaccccttatttaaacccc

SEQ ID NO: 352432 - DNA, 625 bp, Homo sapiens
  misc_feature: GZ8MTXP02JXAAS.25.2.A02.1.454.CMB.2.raw
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagactgtacagtcacgaccggtgctcgatttagactcatctacaggggagctctgagagcggagccccagccccagaattcccaggtgttttcatttggtgatcagcactgaacacagaggactcaccatggagtttgggctgagctgggttttccttgttgttatttttccaggtgtccagagtgaggtgcagttggtggagtcgtgggggagcttggtccagccgtggagggtccgtgagagtctcctgtgcagcctctggattcattcttcagtgaccactacatggactgggtccgccgaggcctaccgaggggaacggggcgtgggaggtggggttggccgttaagtaagaaaataaacgctaaaagacgttaacaccaacagaactaccgccgcgttcgtagtagaaaacggcaagtatttacatttaacnctaanaagagtatagtaattacaaaacgtaacctactaattagtatacgtagaactaaagtacgaaacacgaccgtaaaggaaaacccggtaggaaccgtacggtacgttagtacgttacgtgacgtacgtaacggtacaacgtaccgttacggtactaacccttacccttaacccttataacccg

SEQ ID NO: 352433 - DNA, 592 bp, Homo sapiens
  misc_feature: GZ8MTXP02GMQSK.25.2.A02.1.454.CMB.2.raw
  modified_base (200)..(200): a, c, t, g, unknown or other
  misc_feature (200)..(200): n is a, c, g, or t
  modified_base (424)..(424): a, c, t, g, unknown or other
  misc_feature (424)..(424): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtctcgggacccccggnagacggtccaccctctcttgtctggaagcagctaccaatactacggaactaacactgtagaactggtaccagcacggtacccaggaactccggaccccctaaacttcctactattttaagtagttagttatcacgccgaccctcgacggggttccctgaccgtattctcctcgctacaagtctgcctacctcgacgtccctcccgtgccatcgagtcgggtccngtcgtgaggtatggacggtctgtacttagttactcgcgcagctaggtggactagacagacgtagtagtgggttaggttcggtttcgggacgggtacggggacggaacgtccgtacggtacccgtacgtaacgtacgacggaccgacggtccgtccgtaccccgttccg

SEQ ID NO: 352434 - DNA, 636 bp, Homo sapiens
  misc_feature: GZ8MTXP02FZWHN.25.2.A02.1.454.CMB.2.raw
  modified_base (201)..(201): a, c, t, g, unknown or other
  misc_feature (201)..(201): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtcgtcgggacccccggnagacgtcaccctctcttgttctggaagcagctaccaatatcggaactaacactgtgaactggtaccagcacggtcccaggaactcggacccccaaaatttctactaatttatacgtagtttatcgagccgtaaccctcgacggggttccctagaccgtagttctccgtggcctacaagttctggcctacctcaacgccctccccgtgaacccatcaggtggggtcccaggtcctagagagtcggagtctgtacttaacttacgtcgcgaccgagacctaggtacggaagtcgaacgaacggtccgtaggtaaagttgggggttggtttaacggggtttccgggaggggtacgggaacggtaaacgtcgttaaccggaccgttccggtaaaggtccgaacggacccaacgggtcctccccggtccccgtttaccgg

SEQ ID NO: 352435 - DNA, 538 bp, Homo sapiens
  misc_feature: GZ8MTXP02FJ8HZ.25.2.A02.1.454.CMB.2.raw
  modified_base (199)..(199): a, c, t, g, unknown or other
  misc_feature (199)..(199): n is a, c, g, or t
  modified_base (370)..(370): a, c, t, g, unknown or other
  misc_feature (370)..(370): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggnagacggtcaccctctcttgttctggaagcagctccaatatcggaaactaacactgtgaactggtaccagcaggtcccaggaatcggcccccaaatttctcatttatagtagttatcagccgaccctcgacggggtcccctgaccgtattctcctggcctccaagtctggcncctcagccctcctgccatcagtgggtccagtcgtgaggatgaggctgcttattactgcgcagcagtgggatgacagcctgaagtggtggttgggtttcggcgggagggacgaacggcgtacggaccggtaccgtaaggtccacgcccgaaggtcctcgcccccgtcgg

SEQ ID NO: 352436 - DNA, 616 bp, Homo sapiens
  misc_feature: GZ8MTXP02IMS5P.25.2.A02.1.454.CMB.2.raw
  modified_base (201)..(201): a, c, t, g, unknown or other
  misc_feature (201)..(201): n is a, c, g, or t
  modified_base (319)..(319): a, c, t, g, unknown or other
  misc_feature (319)..(319): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtctcgggaccccccggnagacggtccacccttctcttgttctggaagcagctaccaatactcggaaactaacactgtagaactggtaccagcacggtcccaagaaaccggcccccaagcctcctcatctatagangatcgagcgcctgacggtataccgtgaccccgtattctctcggactcgtagtctggtcctccgtccgtaccctcccgagtcccatccgaggttcggccgtccggtcgagagtcgaggtctagtaatattacgtgtacgtcgttaggtttgggactcggacctagttccgtggtacggtcggtaccggtaacgggttcgttacccggggaggtacggaaccgacggtcgtaccggtacccggtacgttaaccggtcgaaaccggtccccgaaggtccctccccggtccccctttcggg

SEQ ID NO: 352437 - DNA, 572 bp, Homo sapiens
  misc_feature: GZ8MTXP02I5W5N.25.2.A02.1.454.CMB.2.raw
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtgctgactcagccaccctcggtgtctgaacgcccccaggcagaggtcaccatctcctgttctggaagcagctccaacgtcgagataatgctgtaaactggtaccagcaggtcccaggggacgctcccaaactcctcatctattatgatgatctgcctgccctcgaggggtctcgtgaccgtacttctcgtggccttccaagtctggccacctcacgtccctccctggcccatcgagttcggccttccgagtctaggacggtattaggaggtctaggtactttagttacgtgtgacagcgaagtgggaactgacgacggtacctaggtacgttcggggttggggtttcgggttcgggacccgggggttaagggaccccgtaaaggtccgtacggtaaaccccggtttccggg

SEQ ID NO: 352438 - DNA, 747 bp, Homo sapiens
  misc_feature: GZ8MTXP02GV0BW.25.2.A02.1.454.CMB.2.raw
  modified_base (201)..(201): a, c, t, g, unknown or other
  misc_feature (201)..(201): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtctcgggacccccgggnagacggtcaccctctcttgttctggaagcagctccaatatcggaactaacactgtgaactggtaccagcaggtcccaggaatcggccccctaaattctcatttatagttagttatcagccgtaccctcgacggggtcccctagacccgtatttcctcccgtgggtcctaccgaaagttccgtacggccacccgttcaacggtccccttccccgtgggaccctagtcccgtaaggttcgggggtacccaggttccgtggagggtaatcgggaacgggtcttggtctttaaagttacgtcggccgacgagaccgtaaggttcgggggaaattcggaaaccgtacggtccccgttaggtaaaacggtttcgggggttagggttttcgggggtttttaccgggggacgggggttaaaacgggggtaacccggaaaagggtccggtaaccgggtaaccccgggttaccggttaacggggttaccccgtaaacggggtacccccgaaaagggggtccccttaccccgggtacccccccggttttacccgggg

SEQ ID NO: 352439 - DNA, 669 bp, Homo sapiens
  misc_feature: GZ8MTXP02HM89K.25.2.A02.1.454.CMB.2.raw
  modified_base (202)..(202): a, c, t, g, unknown or other
  misc_feature (202)..(202): n is a, c, g, or t
  modified_base (363)..(363): a, c, t, g, unknown or other
  misc_feature (363)..(363): n is a, c, g, or t
  modified_base (510)..(510): a, c, t, g, unknown or other
  misc_feature (510)..(510): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctcagcgtcgtcggggacccccggnagaccggtcaccctctcttgttctggaagcagctaccaatatacggaactaacactgtagaactggtaccagcgacggtcccaaggactccggaccccctaaatttctactaattttactagttagttatcacgccaccctcggacgggtccctgaccgtnttctccgtcggcctacgaagttctcggacctaccctcacgtcccctcccgtcggcctagtccgaggttcggggtcctagtcgtggaagtgtaggacgtcgtagtactttacttacgtcgacgcgtagcgtagtagggatacggaacncggtccgtaggtaaggttgggttgggtttcggggtttacggggacggggtaaacgggaacgggtaaacgtccggttaaccggtacccggtttacggaaacgggttcctaaaccgggtacccggaaacggtcccgttcccccggtaccccggtttcccgg

SEQ ID NO: 352440 - DNA, 718 bp, Homo sapiens
  misc_feature: GZ8MTXP02HR866.25.2.A02.1.454.CMB.2.raw
  modified_base (180)..(180): a, c, t, g, unknown or other
  misc_feature (180)..(180): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcagccaccctnagcgtcgtcgggaccccggcagacggtccacctcttcttgttctggaagcagctaccaatactacggaaactaacactgtacgaacgtcggtaaccagcgacggtcccaaggaactccggaccccaaaactttctactaattttataagtagttatcgacgccgaccctcgacgggtccctagaccgtattctccgtgcctacgaagttcgtcggcctcctcgacgtcccctacccgtcgacccatccggagttcggggtacctaggtccgttagggaaggtagttcgggacggtcgttacgtaccgtttaacgttaccgtcggtaccgacgtacgtaccgtaagggtaggggtagttacggaacgacgggttaccgtaggggttaaacgtttcgggggttggtttttacgggggtttaccggggacgggggtaacgggtaaacgggtaacggtccggtaccggtaccccggttacgggtaaccggttccgaaccggacccggtaacggtcccgtaccccggtacccccgttcccggg

SEQ ID NO: 352441 - DNA, 733 bp, Homo sapiens
  misc_feature: GZ8MTXP02HQZU4.25.2.A02.1.454.CMB.2.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
tcagactgtacagtcacgaccggtgctcgatttagactcatctacaggggagcttcagctgtgggtagagaagacaggactcaggacaatctccagcatggccagcttccctctccctcctcaccctcctcactcactgtgcagggtcctgggcccagtctgtggtgactcagccaccctcagcgtcgtcgggaccccggnagacggtcaccctcttcttgtcnggaancagctaccaatactacggaaactaacactgtagaacgtgtaccagcgacggtaccccgaaggaactcccggaaccccctaaactttcctacttattttaagtagttaagttactacacgtacccgtacccgttcggacggggttccccgtcgtaaccgttactttcctcccgtcggtaccccttaccgtaacggttccgtaccgggtaccctacccgttacccgaccgtcccccgttacccccgtccggaccctaacgtcccggtacgggggttccggggtacccgtacggttccggaggggtaaaggtcggtagggtacggtccgttacgttactttaacgtttacgtcggccgacgtagtacgagggttaggagtacggaacgcgtacgtaggtaggttgggttaggtttcggggtttacgggcggggtaacggacggtacgtccgtacggtaccgtcgtaacggtaccgacggtaccgcggtccgtcccggtcccgttccg

SEQ ID NO: 352442 - DNA, 755 bp, Homo sapiens
  misc_feature: GZ8MTXP02JT5LK.25.2.A02.1.454.CMB.2.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (439)..(439): a, c, t, g, unknown or other
  misc_feature (439)..(439): n is a, c, g, or t
tcagactgtacagtcacgaccggtgctcgatttagactcatctacaggggagcttcagctgtgggtagagaagacaggactcaggacaatctccagcatggccagcttcccctctcctcctcaccctcctcactcactgtgcagggtcctgggcccagtctgtggtgactcagccaccctcgagcgtcgtcgggacccccggnagacggtcaccctctcttgtctggaancagctaccaatatacggaactacactgtagacgtggaccagcgacgtcccgaaggactcggaccccctaaatttctactaattttagtagttagttatacgacgcctacccgtacggtacggggtcccctgaccgtactttctcgtcggctcgacgttctcggctacccgtcacgtccctcgtacgccatcgagttcgggtaccagtcnggagagtcgggacgtcgtacgttcgtttaacgttaccgtggtccgtacggtacgtaccggaacgggtttagggggaaccctttaggaaacccggtaaaccggttccgttaaagggtaaaccgggggttttgggggttccggggtttttacggggggtttttaccccgggggaggggaaaccgggggttaaaccggaaacggttcccgggttaaccggttaaccccggggtaccgggttaaccggttaacccggaacccggggttacccccggaaacggtacccccgggttccccgtacccccccgggtttcccggg

SEQ ID NO: 352443 - DNA, 757 bp, Homo sapiens
  misc_feature: GZ8MTXP02IH6GO.25.2.A02.1.454.CMB.2.raw
  modified_base (200)..(200): a, c, t, g, unknown or other
  misc_feature (200)..(200): n is a, c, g, or t
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtgctgtctcagccaccctcagtgtctcggggcccccggnaggagggtcgacatcttcttgttctggaagtcgctccaacgtcgcaagtaatagtgtaagctggtaaccagacaacctcccgacggaacccggcccccaactacctccctactatagtacgtagggaatgactacgacgccgtcccccgtacgtaccggggtccctacgtaccccgtactttccctcgtccggaccccttacccgaacgttccgtacgggaccctaccccgttccgaccgtccccgtacccgttcgggaccctacgtcccggtgggacctacctaacgttcgtaggagtacgttacggaacgggtcctaattttaaacgtttagttcggtagtccgagggtaccggtaggggtaacttacggaaccggaaagggtaaacgtaaccgggtttagttaccggtttacggttacggttaaaacgggttacggaaacccggtaaacgggtttcccgtaaaccgggttttaccgaacggggttaaccgaaccccgggtaaccccgaaaaccgggtaaaccccctaacccccgtaagtttaaccggtaccccg

SEQ ID NO: 352444 - DNA, 709 bp, Homo sapiens
  misc_feature: GZ8MTXP02JSEC5.25.2.A02.1.454.CMB.2.raw
tcagactgtacagtcacgaccggtgctcgatttagactcatctacaggggagcttcagctgtgggtagagaagacaggactcaggacaatctccagcatggccagcttccctctcctcctcaccctcctcactcactgtgcagggtcctgggcccagtctgtggtgactcaaccaccctcagcgtctcggggaccccccggcaggaccggtccacccttctcttgttctggaagcagcctcaatatacggaactaacactgtagaactggtaccagcgaggtcccaggaatcggaccccctaaactttctacattttatagttagttatcacgccgaccctcgtacggggtccctgaccgtattcctcgtccggtcctaccgaaggtcctaggccaccttccaccggtccccttcccgtgggtacccactttacgaacgggttccgggggtacctaacggttcgttacgggagggtacgtagggaacgggtcgttaggtaccttttacgttacgtcggccgacgacgtcgtagtcggggtagtacggaccgacggtaccgtaggtaacggttggggtttacggggtttcggggtttttacgggggaccggggttaagggggaacggtaaacggcggttaccggaccggtttaccgtacggtcgaaccggtacccggaacggtccgtccggtacccccgtacgggtcccg

SEQ ID NO: 352445 - DNA, 714 bp, Homo sapiens
  misc_feature: GZ8MTXP02FI0NV.25.2.A02.1.454.CMB.2.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
tcagactgtacagtcacgaccggtgctcgatttagactcatctacaggggagcttcagctgtgggtagagaagacaggactcagggacaatctccagcatggccagcttccctctcctcctcacccctcctcactcactgtgcagggtcctgggccccagtctgtggtgactcagccaccctcagcgtctcgggacccccggnagacggtccaccctctcttgttctggaagcagcctaccaatagtcggaactacactgtanaactggtaccagccacggtcccaggaactcggaccccaaacttctctatttactagtagttancagccgacccncgacggggttcccctagaccgtactttcctcccgtcggacctaccgaacgttcgtcgggaccctacccttcgaaccgtcccttcccgtgggtacccacgttacgtaacggttcgggggtaccctaacggttccgttaggaacgggtacgtagggaacggtaccgtcggttacctttaacgttaaccgttccggtccgtacgtacggaccgtaacggttgggtacgtacggaacgtacgtacccgtagtaaaggttgggttcggtttcggggttttacggggacgggggtaacggggaacggaacggtacgtaccggtaccggttaccgttaacggaccgaacggacccgaacggtcctcccggtacccccgttccgg

SEQ ID NO: 352446 - DNA, 382 bp, Homo sapiens
  misc_feature: GZ8MTXP02JQGN7.25.2.A02.1.454.CMB.2.raw
  modified_base (339)..(339): a, c, t, g, unknown or other
  misc_feature (339)..(339): n is a, c, g, or t
  modified_base (366)..(382): a, c, t, g, unknown or other
  misc_feature (366)..(382): n is a, c, g, or t
tcagactgtacagtcacgaccggtgctcgatttagactcatctacagggacaacgccaagaactcactgtatctgcaaatgaaccagcctgagagccgaggacacggccgtgtattactgtgcgagagacagttacgatatttgactggttattagtggggggcctactactactacatggacgtctggggcaaagggaccacggtcaccgtctcctcagcctccaccaagggcccatcggtcttccccctggccaccctcctccaagacgcacctcgtgggggcacaggccgcctggcctgccgtggtcaaggctacgtccactgtacagtctggacncggggctgggacaagggcgacaagtgnnnnnnnnnnnnnnnnn

SEQ ID NO: 352447 - DNA, 479 bp, Homo sapiens
  misc_feature: GZ8MTXP01C4835.15.3.A03.1.454.CMB.2.raw
  modified_base (300)..(300): a, c, t, g, unknown or other
  misc_feature (300)..(300): n is a, c, g, or t
  modified_base (391)..(391): a, c, t, g, unknown or other
  misc_feature (391)..(391): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagtctacgtagccacgaccggtgctcgatttagagagcgtcacaggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataagaactacttagcttggatcaagaaaaaccaggacagcctctaagctgctcatttacnggcatctaccggatccgggtcctgacgattccagtggcagcggtctggcacagtatttcactctcaccatcagcagcctgcaggctgaagntgtgctaggtttatactgtcagtaatntgaaatnttcctttatcgcctggacaaagtgatatcaaacgcttgtgctgcacatcttgtc

SEQ ID NO: 352448 - DNA, 539 bp, Homo sapiens
  misc_feature: GZ8MTXP01DDD9V.15.3.A03.1.454.CMB.2.raw
  modified_base (436)..(436): a, c, t, g, unknown or other
  misc_feature (436)..(436): n is a, c, g, or t
tcagtctacgtagccacgaccggtgctcgatttagagagcgtcacaggggctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttatacagctaccaaacaaataagaactacttagcttggtatacaagaaaaaaccaggacagcctctaagctgctcattactggcatctacccggatccgggtcctgacattccagtgcagcggtctggcacagtatttcactctcaccatcagcagcctagcaggctagaagatgtgctaggtttatactgtcagcaaatatacgaaagttntttccctttaactttcgggaaccccttggggaaccctaaaaggttggtaattaattacaaaacgttaacttggtacgggtccttggaccacctaattccttcg

SEQ ID NO: 352449 - DNA, 568 bp, Homo sapiens
  misc_feature: GZ8MTXP01D5DC6.15.3.A03.1.454.CMB.2.raw
  modified_base (303)..(303): a, c, t, g, unknown or other
  misc_feature (303)..(303): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataagaactacttagcttggatcaagaaaaaaccaggacagcctactaagctgctcatttacnggcatctacccggaatccgggtcctgaccgattccagtggcagcggtctggcacagatttcactctcaccatcagcagcctgcaggctagaagatgtgctagggtttatacgtgtacagtactaaagtatagtaaaagtttctttacccttttacgtttccgggccccttaggggaaccctaaaaggttcgggtaaattacttaaccgaaaacgttaaaccgttggtacgggtccttacggaccaacccgtaagttcccgtttcg

SEQ ID NO: 352450 - DNA, 509 bp, Homo sapiens
  misc_feature: GZ8MTXP01BEJYY.15.3.A03.1.454.CMB.2.raw
  modified_base (228)..(228): a, c, t, g, unknown or other
  misc_feature (228)..(228): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctcaacaataagaactactagcttggtatacaagaaaaaccaggacagcctctaagctgctcattactggcatctacccggaatccgggtcctgaccgattccagtgcagcggtctggcacagatttcactctcacatcagcagcctgcaggctgaagatgtggctagggtttattactgtcagcaatatagtaaagttatttccttttaactttcgggccccttggggaccctaaagttggaatattcgaaacgactgtggctgcacctaattctg

SEQ ID NO: 352451 - DNA, 539 bp, Homo sapiens
  misc_feature: GZ8MTXP01DHX8B.15.3.A03.1.454.CMB.2.raw
  modified_base (229)..(229): a, c, t, g, unknown or other
  misc_feature (229)..(229): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctaccaacaaataagaactacttagcttggatacaagaaaaaaccaggacagcctactaagctgctcatttactggcatccgtaacccgggaatcccggggtcctgaccgtattccgagtgcaggcgggtctggcacagtactttcactctcaccatcagcagcctgacaggctagaagatgtagctagggtttacttacgtgtacagactaaatatagtaaattctttcctttacgttccggccctaggggaaccctaaaggttggaatattacgaaacgttaactgtagctgcacctnttcgtn

SEQ ID NO: 352452 - DNA, 516 bp, Homo sapiens
  misc_feature: GZ8MTXP01ESS1E.15.3.A03.1.454.CMB.2.raw
  modified_base (306)..(306): a, c, t, g, unknown or other
  misc_feature (306)..(306): n is a, c, g, or t
  modified_base (444)..(444): a, c, t, g, unknown or other
  misc_feature (444)..(444): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
tcagtctacgtagccacgaccggtgctcgatttagagagcgtcacaggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctaccaaacaaataagaactacttagcttggatacaagaaaaaccaggacagcctacctaagctgctcatttacnggcatccgtacccgggaatccggggtcctgaccgattccagtggcagcggtctggcacagatttcactctcaccatcagcagcctgcaggctagaagatgtagctaggtttatactgtcagcaaatatagtaaagttntttacctttacttcggccctgggacctaaaggttggaataattacgaaacgaactgtgctgcactnttcgtn

SEQ ID NO: 352453 - DNA, 612 bp, Homo sapiens
  misc_feature: GZ8MTXP01CYOXN.15.3.A03.1.454.CMB.2.raw
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacanctacaanaataanaactactagntaganacaaagaaaacagacacncctactaagctnctactattacgnggactacgtaccgtaacccgggaacgtcccgggtcctacgaccgtattcccgaggtcggacgacggtcggtcgtcggcaacgtagtactttaccacctcctaccaacctatcacgacacgcctagaccgaggactaggaaagtagtggtaggtactttaagggttttaacttacgtgtacaagtactaataagttaagtaaacgttaactttaccgtttaccgtttccgtaaccgtacggttaacgtaaacgttagtaagtaacttaacgttaacgttaacgtaagtagtcgtcgacactaacgttcgtg

SEQ ID NO: 352454 - DNA, 562 bp, Homo sapiens
  misc_feature: GZ8MTXP01AK6W0.15.3.A03.1.454.CMB.2.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
tcagtctacgtagcccacgaccggtgctcgatttagagagcgtcacaggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaacaataagaactactagcttggatacaagaaaaaccaggacagcctactaagctgctcatttacnggcatctacccgggatccggggtcctgaccgattccagtggcaggcgggtctggcacagtactttcactctacaccatcagcagcctgcagctagaagatgtgactagggtttatacgtgtacagtcaattagtagtaaaagttctttaccttttaacgttccggaaccccttaggggaaccctaaaaggttcggtaattaacgttaccgaaaacgttacgttggttacgggccttggaccttaccctaattcccgttg

SEQ ID NO: 352455 - DNA, 573 bp, Homo sapiens
  misc_feature: GZ8MTXP01AHDWX.15.3.A03.1.454.CMB.2.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (444)..(444): a, c, t, g, unknown or other
  misc_feature (444)..(444): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaacaataagaactacttagcttggatacaagaaaaaccaggacagcctcctaagctgctcatttacnggcatctacccggaatccgggtcctgaccgattccagtgcagcggtctggcacgagtattcactctcaccatcagcagcctgcagggctagaagtatggtgactagggtttatacgtgtacagcaatagtagtaaagttntttaccgttttaacttccggtaacccctagggggaaaccctaaagggttcggtaaattaacgttaccgttaaaacggttaaccgttgggttacggaaccgttacggaccttacctaacgttcgtttccg

SEQ ID NO: 352456 - DNA, 568 bp, Homo sapiens
  misc_feature: GZ8MTXP01B6JE0.15.3.A03.1.454.CMB.2.raw
  modified_base (229)..(229): a, c, t, g, unknown or other
  misc_feature (229)..(229): n is a, c, g, or t
  modified_base (312)..(312): a, c, t, g, unknown or other
  misc_feature (312)..(312): n is a, c, g, or t
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctaccaaacaaataagaactacttagcttaggatacaagaaaaaaccaggacagcctacctaagctgctacatttacgnggcacgtccgtaaccccgggaagtcccgggggtccctggacccgtattccccgaggtggcgaggcgggtactgggcacagtatttccacttcncaccatcagcagcctgcaggctagaantggtgctaggtttatactgtacagcaatatagtaaattcttcctttacgttccggaacccgttagggaacctaaaggttcgtaaatacttaacgttaaacgttactggtggtaactcgaccttacctaattcgtcg

SEQ ID NO: 352457 - DNA, 619 bp, Homo sapiens
  misc_feature: GZ8MTXP01DIIMM.15.3.A03.1.454.CMB.2.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccaagagttgttttanacagctaccaacaataagaactactagcttggatacaagaaaaaccaggacacgcctactaagctgctctatttacnggcatccgtacccgggatcccgggtcctgaccgnttccagtgcaggcggtcnggcanagtacttcactctcaccntcagcagccctgaccgaggtctaggaaagtgtggtagggtacttaagggttttaactttacgtgttacgagtactaaagtttagttaaagttaaacgttttccttttaccctttttaaccggtttcccggggtaacccgtttaacgggggaaacccttaaagggttaggtaaattaacgttaaaccgttaaacgttacgttggtacggtcttcgaccttaacctcttccgtttccg

SEQ ID NO: 352458 - DNA, 579 bp, Homo sapiens
  misc_feature: GZ8MTXP01D2HT8.15.3.A03.1.454.CMB.2.raw
  modified_base (229)..(229): a, c, t, g, unknown or other
  misc_feature (229)..(229): n is a, c, g, or t
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagttgttttanacagctaccaaacaaataagaactacttagcttaggtatacaagaaaaaaccaggacagccctacctaagctgctcatttacnggcatcgtacccggatccgggtccngaccgattccagtggcagcgggtctggcacgagtatttcactctacaccatcagcagcctgcgaggctggaagatggtaggcttagggtttacttatgtcaagctaaatagtaagtaaagtttctttcccttttaacgttccggtcccttaagggggaaccctaaaaggttcggtaaataacgttaaccgaaaacgaaccgttggttaacgggccttaggcccttaaaccttcgttccgttg

SEQ ID NO: 352459 - DNA, 530 bp, Homo sapiens
  misc_feature: GZ8MTXP01CFMLR.15.3.A03.1.454.CMB.2.raw
  modified_base (305)..(305): a, c, t, g, unknown or other
  misc_feature (305)..(305): n is a, c, g, or t
  modified_base (403)..(403): a, c, t, g, unknown or other
  misc_feature (403)..(403): n is a, c, g, or t
  modified_base (523)..(523): a, c, t, g, unknown or other
  misc_feature (523)..(523): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaaacaataagaactacttagcttggatacaagaaaaaccaggacagcctctaagctgctcatttacnggcatccgtacccggatccgggtcctgaccgattccagtggcagcgggtctggcacgagtactttcactctcaccatcagcacgcctgcaggctgagntgtgctaggtttatcgtgtcagcaatatagtaaagttctttccgttttacttccggtccccgttaggggaaccctaaaggttggtaatacttacgaaacgttactgtggctgcttacctnttcgtcg

SEQ ID NO: 352460 - DNA, 522 bp, Homo sapiens
  misc_feature: GZ8MTXP01AGOC5.15.3.A03.1.454.CMB.2.raw
  modified_base (273)..(273): a, c, t, g, unknown or other
  misc_feature (273)..(273): n is a, c, g, or t
  modified_base (359)..(359): a, c, t, g, unknown or other
  misc_feature (359)..(359): n is a, c, g, or t
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
  modified_base (505)..(505): a, c, t, g, unknown or other
  misc_feature (505)..(505): n is a, c, g, or t
  modified_base (516)..(516): a, c, t, g, unknown or other
  misc_feature (516)..(516): n is a, c, g, or t
tcagtctacgtagccacgaccggtgctcgatttagagagcgtcacaggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataagaactacttagcttggatcaagaaaaaccnggacagcctctaagctgctcatttactgggcatctacccgggaatcccgggggtccctgaccgattccagtgcagcggtctggcanagatttcactctcaccatcagcacgcctgcaggctagaaagntgtgctaggtttatactgtcagcaagtntagaaagttntttacctttacgtcggtccctaggggttaccaaaggttggataattcgaaaccgttagttaacggngtctgacactnttcgtg

SEQ ID NO: 352461 - DNA, 516 bp, Homo sapiens
  misc_feature: GZ8MTXP01AVOL9.15.3.A03.1.454.CMB.2.raw
  modified_base (227)..(227): a, c, t, g, unknown or other
  misc_feature (227)..(227): n is a, c, g, or t
tcagtctacgtagccacgaccggtgctcgatttagagagcgtcacaggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctcaacaataagaactacttagcttggatcaagaaaaaccaggacagcctcctaagctgctcatttactgggcatctacccgggaatcccgggggtccctgaccgattcccagtggcaggcgggtctgggcacgagatttcactctcaccatcagcagcctgcaggctgaagatgtgcaggtttatactgtcagcatatagtaagtattctttacttacgtccgtcggttaccgtaagttaggtagtattacaacgaactaagtggcgtgcactaacttcgttcg

SEQ ID NO: 352462 - DNA, 559 bp, Homo sapiens
  misc_feature: GZ8MTXP01AH0S3.15.3.A03.1.454.CMB.2.raw
  modified_base (228)..(228): a, c, t, g, unknown or other
  misc_feature (228)..(228): n is a, c, g, or t
  modified_base (302)..(302): a, c, t, g, unknown or other
  misc_feature (302)..(302): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaacaataagaactactagcttggatacaagaaaaaccaggacagcctactaagctgctcattacnggcatccgtacccggatcccgggtcctgaccgtatccaggtgcaggcggtctggcacagtatttcactctcaccatcagcagcctgcagctagaagatgtgctagggtttatacgtgtacagtcaatatagtaaattctttaccttttacgttccggtcccgtagggttaacctaaaggttggtaaacttaacgttaaccgttaaaacggttaccgttgggtacggtccttcggacccttaacctaattccgtttcg

SEQ ID NO: 352463 - DNA, 646 bp, Homo sapiens
  misc_feature: GZ8MTXP01DTQOD.15.3.A03.1.454.CMB.2.raw
  modified_base (229)..(229): a, c, t, g, unknown or other
  misc_feature (229)..(229): n is a, c, g, or t
  modified_base (310)..(310): a, c, t, g, unknown or other
  misc_feature (310)..(310): n is a, c, g, or t
  modified_base (376)..(376): a, c, t, g, unknown or other
  misc_feature (376)..(376): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctaccaaacaaataagaactacttagcttggatacaaagaaaaaaccaggacagccctactaagctgctcatttacngggcatccgtaacccgggaagtcccgggggtccctgaccgattccaggtggcaggcggtctggcanagtatttcactctcaccatcagcacgcctgacagggctaggaaagatggtagggtacttaaggggttttaacttacgtagttaccaaggtacctaaattaagttaaaggttaaaacgtttactttttaccccgtttttaaacgtttcccgggtaaccccgtttaaggggaaacccgtaaaaggttcgggtaaattaacgttaaaccgttaaaaccggttaaacgttgggtaacggcttacggaccttaaccctaagtttccgtttaaccg

SEQ ID NO: 352464 - DNA, 529 bp, Homo sapiens
  misc_feature: GZ8MTXP01DIMMX.15.3.A03.1.454.CMB.2.raw
  modified_base (315)..(315): a, c, t, g, unknown or other
  misc_feature (315)..(315): n is a, c, g, or t
  modified_base (417)..(417): a, c, t, g, unknown or other
  misc_feature (417)..(417): n is a, c, g, or t
  modified_base (444)..(444): a, c, t, g, unknown or other
  misc_feature (444)..(444): n is a, c, g, or t
  modified_base (458)..(458): a, c, t, g, unknown or other
  misc_feature (458)..(458): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
  modified_base (529)..(529): a, c, t, g, unknown or other
  misc_feature (529)..(529): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctaccaaacaaataaagaactacttaagcttaggtatacaaagaaaaaaccaggaacacgcctactaaagctgctcatttacnggcatctaacccgggaatccggggtcctgaccgattccgagtggcagcgggtctggcacagtatttcactctacaccatcagcagcctgcaggctagaaagntgtgactaggtttattactgtacaganaatatagtaaattntttcctttaactcggccctagggacctaaagttgaatattacgaaacgttatgaggntcgnaccaattctn

SEQ ID NO: 352465 - DNA, 907 bp, Homo sapiens
  misc_feature: GZ8MTXP01APX3B.15.3.A03.1.454.CMB.2.raw
  modified_base (228)..(228): a, c, t, g, unknown or other
  misc_feature (228)..(228): n is a, c, g, or t
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaaacaaataagaactacttagcttaggatacaagaaaaaccngacacgcctactaagctgctctatttacgngggacacgtaccgtaaccccgggggtaacgttcccccgggggttacccctacggtaaccccggtactttacccccggaaggttcgggggaccgtaacggggtcccgggggttacccgttcgggggaaccctaaaccgtaaacgggttaacttttttacccgaaaccctttcccgttaaccccgaaaacccctaacctttaccgaaaacgggtcccaaaccgggtacccccgttgggaccccgaacgggggtaaccttaagggaaaaacggtaacgtttcggggtaggggttaacccttttaaagggggttttttaacgtttaaaccgttcgggttaaccctaaagggaacccttaaaaagtttaacgtttaaaggttaaaaaaaccggtttttccctttttaaaccccgttttttttaaaacccgggtttccccgggggttaacccccggtttaaacggggggttaaaacccctaaaaacggggttttcgggaaaacgtttaaacttaaaccccggttaaaaaacggttaaacccggtttggtaacggggtaacgtttaaccgacccgttaaaacctaacggttttccgtttaacccg

SEQ ID NO: 352466 - DNA, 554 bp, Homo sapiens
  misc_feature: GZ8MTXP01CMWAX.15.3.A03.1.454.CMB.2.raw
  modified_base (227)..(227): a, c, t, g, unknown or other
  misc_feature (227)..(227): n is a, c, g, or t
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttanacagctaccaacaataagaactactagcttggatcaagaaaaaccnggacagcctactaagctgctcatttacnggcatcgtacccgggaatccggggtccctgaccgattccagtggcagcggtctggcacagatttcactctcaccatcagcagcctgcaggctagaagatgtgctagggtttattacgtgtacagcaatagtagaaagttctttccttttaacttccggaaccccttaggggaaccctaaaaggttggtaaacttacgttaccgttaaaacggttaacttggtaggccttggaccaccctaagttctttaaccg

SEQ ID NO: 352467 - DNA, 538 bp, Homo sapiens
  misc_feature: GZ8MTXP01DNJHS.15.3.A03.1.454.CMB.2.raw
  modified_base (229)..(229): a, c, t, g, unknown or other
  misc_feature (229)..(229): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctcaaacaataagaactacttagcttggatacaagaaaaaccaggacagcctcctaagctgctcatttactgggcatctacccggaatccgggtcctgaccgattccagtgcagcggtctggcacagtatttcactctcaccatcagcagcctgcaggctagaagatgtggctagggtttattacgtgtacagacaatataggtaaattatttcccttttaacttcggtccctaggggaaaccctaaaggttggtaaattaattaacaaacgttaacctggtggaactgacacctaattcgttcg

SEQ ID NO: 352468 - DNA, 575 bp, Homo sapiens
  misc_feature: GZ8MTXP01C5R9C.15.3.A03.1.454.CMB.2.raw
  modified_base (230)..(230): a, c, t, g, unknown or other
  misc_feature (230)..(230): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgttttanacagctaccaacaaataagactacttagcttggtatacaagaaaaaaccaggaacagcctactaagctgctcatttacgtggcatccgtacccgggaatccggggtccctgaccgtattccgagtggcaggccgggtctgggcacgagtactttcactctcaccatcagcagcctgcaggctagaagatggtgactaggtttacttacgtgtacagctaatataagtaaacgttacttttacctttaacgtttccggcccgttggggaaaccctaaagggttcgtaaatacttaacgttaaacgttacgttggtcggcttacggccttaccctaagttcttaacg

SEQ ID NO: 352469 - DNA, 653 bp, Homo sapiens
  misc_feature: GZ8MTXP01CSAYD.15.3.A03.1.454.CMB.2.raw
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtggcgagagggccaccatcaactgcaagtccagccagtagtgttttatacagctaccaaacaaataagaactatagcttgatacaagaaaaaccagacagccctactaagctgctactatttacgtgggaccacgtacccgtaaccccggggaacgtccccgggggtccctacggacccgtatttaccccgaggtggcgacggtccgggtcgtggcacgtagtactttcactctaccaacatcagcagtccctgacacgggctaggaagagtggtaggtacttagggttttaactacgttgtaccaagtactaaattagttaagtaaaacgtttcttttacccgttttaacgtttcccgggaaccccttaaggggaaacccgttaaaaggttgggtaaaccttagttaaacccgaaaacggttaaccgttggtacggtccttcggaccttaaccccgtaattcccggtttc

SEQ ID NO: 352470 - DNA, 637 bp, Homo sapiens
  misc_feature: GZ8MTXP01EQQSS.15.3.A03.1.454.CMB.2.raw
  modified_base (232)..(232): a, c, t, g, unknown or other
  misc_feature (232)..(232): n is a, c, g, or t
  modified_base (323)..(323): a, c, t, g, unknown or other
  misc_feature (323)..(323): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagtagttgttttaanacacgctaccaaacaaataaagtaactactagtcttaggtatacaaagaaaaaaccgaggaacacgacctactaagctgctatatttacgnggcatccgtaccggagtccgggtcctgacgattccgagtggcgagtcggtctggcacgtagtactttcacttcacaccatcagcacgccctgacgtagtactaggaaagtgttaggtcgtacttaaggggttttacttaaccgtggttaccaagtacctaaagtttagtaaacgtttaaagtttaccttttaccgtttttaacgtcccgggaacccgttaagggttaaaccgtaaaggtttacggaaattaacgttaaaccgaaaacgttacgttcgggtcggtaacgtctacccaaacttcttcggtttaacc

SEQ ID NO: 352471 - DNA, 526 bp, Homo sapiens
  misc_feature: GZ8MTXP01D7YTT.15.3.A03.1.454.CMB.2.raw
tcagtctacgtagccacgaccggtgctcgatttagagagcgtcacagggggctacaacaggcaggcaggggcagcaagatggtgttgcagacccaggtcttcattcctctgttgctctggatctctggtgcctacggggacatcgtgatgacccagtctccagactccctggctgtgtctctgggcgagaggccaccatcaactgcaagtccagccagagtgttttatacagctaccaacaataagaactactagcttggatacaagaaaaaccaggacagcctacctaagctgctcatttactgggcatccgtacccgggaatccggggtccctgaccgattccagtggcagcggtctggcacagacttcactctcaccatcagcagcctgcaggctagaagatgtggctaggtttattactgtcagcaaatataagtaaagttactttccttttacttccggcccttggggaaccctaaaggttgaatattacgaacgaactggtagctgacacctaattcttg

SEQ ID NO: 352472 - DNA, 590 bp, Homo sapiens
  misc_feature: GZ8MTXP01BZWU0.15.3.A03.1.454.CMB.2.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaacaataagaactacttagcttggatcaagaaaaaccaggacagcctacctaagctgctcatttacngggcatccgtacccgggaatcccggggtcctgaccgattccgaggtggcaggcgggtctgaacacagtatttcactctcaccatcagcagcctgcaggctagaagatggtagctaagggtttatacgtgtacagcaaattacgtagtaaacgttcttttacccgttttacgttcccgggaaccccgttaggggaaaccctaaagggttcggtaaacttaacgttaccgttaaaacggttaccgttaagggtcgggtcttacggaccttaaccctaattccgttcg

SEQ ID NO: 352473 - DNA, 557 bp, Homo sapiens
  misc_feature: GZ8MTXP01BGZ6P.15.3.A03.1.454.CMB.2.raw
  modified_base (275)..(275): a, c, t, g, unknown or other
  misc_feature (275)..(275): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
  modified_base (551)..(551): a, c, t, g, unknown or other
  misc_feature (551)..(551): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctaccaacaataagaactactagcttggatacaagaaaaaccnggacacgcctacctaagctgctctatttactgggctactccgtacccgggaacgtcccggggtccctagaccgattccgaggtggcgagcgggtctggcacagactttcactctcaccatcancagcctgccagctgaatntgtggtactaggttttatcgtgtacagactaattagtagtaaagtttctttacccttttacgttccggccttaggggaacctaaaggttggtaatacgttaccgaaagttacgtgtaggcttcggcttaaccttnttcgtg

SEQ ID NO: 352474 - DNA, 586 bp, Homo sapiens
  misc_feature: GZ8MTXP01ARMX1.15.3.A03.1.454.CMB.2.raw
  modified_base (232)..(232): a, c, t, g, unknown or other
  misc_feature (232)..(232): n is a, c, g, or t
  modified_base (310)..(310): a, c, t, g, unknown or other
  misc_feature (310)..(310): n is a, c, g, or t
  modified_base (432)..(432): a, c, t, g, unknown or other
  misc_feature (432)..(432): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagagggccaccatcaactgcaagtccagccagagttgtttanacagctaccaacaataagaactacttagcttggatacaagaaaaaccaggacagcctactaagctgctctatttacgnggcagtccgtaacccgggaacgtcccgggggtccctggacctattcccaggtggcaggcgggtctgggcacagtatttccactctcaccatcacgcacgcctgacaggctaggaagagtggnggtactaggtttactactgtacagacaatagtagtaaattctttaccttttacgttccggaaccctagggttaaaccctaaagttcggtaataacttaccgaaaacggttacgttggtcgggcttcggaccttaaccctaagttcccgtttaag

SEQ ID NO: 352475 - DNA, 683 bp, Homo sapiens
  misc_feature: GZ8MTXP01AMUER.15.3.A03.1.454.CMB.2.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactcctggctgtgtctcgtgggcgaggacgggccacatcaactgacaagtccagccagtagttgtttanacagctaccaaanaataagaactacttagcttaggtatacaagaaaaaccgngacacgcctactaagctgctactatttacgngggactacgtccgtaacccgggaacgttcccgggggtccctaggacccgtattcccgaggtggccgtacggccgggtacgtgggccaacgtacgtactttcaaccttctacacctactcaacgtcacgtccctagaccgacggtcgtaaggaaagtcgttacgggtagggtccttaaaggggttttcttaacgtgttaccgaagtactaaagttagttaaggtaaactttcgttttacccgttttaaccggttccggaacccgttacggggttaacccgtaaaggttcggtaaacttaacgttaccgaaacccgttaacgtttggtacggtaacttacggccttaaaccgtaacgtttccgttaaccg

SEQ ID NO: 352476 - DNA, 577 bp, Homo sapiens
  misc_feature: GZ8MTXP01DH1KP.15.3.A03.1.454.CMB.2.raw
  modified_base (230)..(230): a, c, t, g, unknown or other
  misc_feature (230)..(230): n is a, c, g, or t
  modified_base (384)..(384): a, c, t, g, unknown or other
  misc_feature (384)..(384): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctaccaaacaaataagaactacttagcttggatacaagaaaaaccaggacagccctactaagctgctctatttacgtggactataccgtaacccgggaagtcccgggggtccctgaccgtattcccgaggtggcgaggcgggtctggcanagtattcactctcaccatcagcagcctgacaggctagaagatgtagctagggtttattactgtacagactaatagtaagtaaagttactttaccgttttactttccgggaacccgttagggaaccctaaaggttggtaataacgttacgttaaaaccgttaagtggtaggcttggaccacctaagttcgttcg

SEQ ID NO: 352477 - DNA, 586 bp, Homo sapiens
  misc_feature: GZ8MTXP01BMKFF.15.3.A03.1.454.CMB.2.raw
  modified_base (229)..(229): a, c, t, g, unknown or other
  misc_feature (229)..(229): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttanacagctaccaacaaataagaactacttagcttggatacaagaaaaaaccaggacagcctcctaagctgctcatttactgggcatcctaacccgggaactcccgggggtcctggccgattccaggtggcagcgggtctggcacagtattcactctcacatcagcagcctgacaggctagaagatggtgacttaggtttacttacgtgtacaagctaaattagtagtaaacgttactttcccttttaaccgtttccggaaccccgttagggaacccgtaaaagttgggaaacttaacgttaacgaaaacggttacgttaacggtagggtaaccttcggacttaaccctaagtttcttcg

SEQ ID NO: 352478 - DNA, 590 bp, Homo sapiens
  misc_feature: GZ8MTXP01DVRDL.15.3.A03.1.454.CMB.2.raw
  modified_base (171)..(171): a, c, t, g, unknown or other
  misc_feature (171)..(171): n is a, c, g, or t
  modified_base (233)..(233): a, c, t, g, unknown or other
  misc_feature (233)..(233): n is a, c, g, or t
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
  modified_base (466)..(466): a, c, t, g, unknown or other
  misc_feature (466)..(466): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactcccnggctgtgtctctgggcgagagggccaccatcaactgacaagtccagccagtagttgttttanacagctaccaaacaaataagaactacttagcttaggtatacaaagaaaaaaccaggacacgcctacctaagctgctactatttactgggcagtacccgtaacccgggaagtcccgggggtccctgaccgtattccaggtcggcgaggcgggtctgggcactagtactttcactctcacctatcancagcctgcgaggtntagagtgtgtagtcttaggtttactacgtgacanataatagttaaagttactttactttaccgtttaccgtccggtaaccgttaaggaactaaaggttagtaaactaacgttaaccgttaaagttacgtggtacgctacgaccttattaacgttctcg

SEQ ID NO: 352479 - DNA, 802 bp, Homo sapiens
  misc_feature: GZ8MTXP01EIG34.15.3.A03.1.454.CMB.2.raw
  modified_base (229)..(229): a, c, t, g, unknown or other
  misc_feature (229)..(229): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttanacagctaccaaacaaataagaactacttagcttggatacaaagaaaaaaccaggaacacgcctactaagctgctactactttacgtgggactacgtacccgtaaccccggggtaacgttcccgggggttacccctaggaacccgtatttacccgaaggttcggaccgaacgggtcccgggggttaaccgttcgggaaccgtaaacgtaaggttaacctttttccgaacctttacccgttaccaaccctacgttacccgaaaggcccgaacggtcccccgttagggacccgaggggtaccttaaagggaaaccgttaagttgggggtaccgggttactttaaacggggtttttaatttaacccggttggttaaccggaagtaaccgtaaaatttagttaaaagggtaaaactttttccgtttttaccccgttttttaaccgggtttccccgggtaacccggtttaacggggaaaaccccgtaaagggtttacggtaaatttaaacgttaccgttaaaacgttaaccggttgggtacggtaactcggaacccttaccgtaactttccggttaacg

SEQ ID NO: 352480 - DNA, 564 bp, Homo sapiens
  misc_feature: GZ8MTXP01CJQSG.15.3.A03.1.454.CMB.2.raw
  modified_base (233)..(233): a, c, t, g, unknown or other
  misc_feature (233)..(233): n is a, c, g, or t
  modified_base (312)..(312): a, c, t, g, unknown or other
  misc_feature (312)..(312): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagtagttgtttanacagctaccaaacaataagaactacttagcttggatacaagaaaaaccaggacagcctactaagctgctctatttacgngggcatccgtacccgggaactcccggggtccctgaccgtattcccgagtggcgaggcgggtctgggcacgagtatttcactctacaccatcagcacgcctgcagggctagaagatggtgcttaggtttatactgacagactaatatagtaaacgttactttaccttttacgttccgcccgttaggaaccgtaaagttcggtaatacaaccgaaacgttaccgtgtacggtctagccaccgtaattcttaacg

SEQ ID NO: 352481 - DNA, 526 bp, Homo sapiens
  misc_feature: GZ8MTXP01BRHHY.15.3.A03.1.454.CMB.2.raw
  modified_base (228)..(228): a, c, t, g, unknown or other
  misc_feature (228)..(228): n is a, c, g, or t
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttanacagctacaacaataagactactagcttggatacaagaaaaaccaggacagcctcctaagctgctctatttactgggcatccgtacccgggaatccgggggtacctgaccgattcccaggtggcaggcggtctgggcacagtatttcacttcacaccatcagcagcctgcaggctagaagntgtgactagggtttatactgtacaganatatataagtattactttacttcgtccgtcggaccgtaagttaggtatacttacttaacgaacgtaagtggcgcacactaacgttcgtcg

SEQ ID NO: 352482 - DNA, 582 bp, Homo sapiens
  misc_feature: GZ8MTXP01DMSM7.15.3.A03.1.454.CMB.2.raw
  modified_base (311)..(311): a, c, t, g, unknown or other
  misc_feature (311)..(311): n is a, c, g, or t
  modified_base (410)..(410): a, c, t, g, unknown or other
  misc_feature (410)..(410): n is a, c, g, or t
  modified_base (439)..(439): a, c, t, g, unknown or other
  misc_feature (439)..(439): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaaacaaataagtaactacttagcttggtatacaagaaaaaaccaggacagcctactaagctgctcatttacnggcatccgtacccggaatccgggtcctgaccgattccagtgcagcggtctggcacagtatttcactctacaccatcagcagcctgacaggctagaaagntgtaggcttagggtttactacgtgtacanctaaatataagtaaacgtttctttaccctttacgttccgggccctaggggttaaaccctaaagggttcggtaaattacgttaaaccgaaacgttaaaccgttggtgggtaaccttcggaccttaacccgttcgttcgttaacg

SEQ ID NO: 352483 - DNA, 628 bp, Homo sapiens
  misc_feature: GZ8MTXP01AOZSN.15.3.A03.1.454.CMB.2.raw
  modified_base (231)..(231): a, c, t, g, unknown or other
  misc_feature (231)..(231): n is a, c, g, or t
  modified_base (282)..(282): a, c, t, g, unknown or other
  misc_feature (282)..(282): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccacatcaactgcaagtccagccagtagttgtttanacagctacaaacaataagaactacttagcttaggaatacaaagaaaaaccnggacacgcctactaagctgctactatttacgaggctacgtaccgtaacccgggacgtcccggggtcctagaccgtattcccgaggtcggacaggcggtctggcacagtacttcactctacaccatcacgcagtccagaccgaggtctaaggaagtgtgggtagtacttaaggggttttaacttaccgtgtaccaagtaactaaagttagtaaggttaaactttccttttaccgttttaaccgtccgggtaacccgtaaggggttaaacctaaaggttcggtaaactttaaacgaaccgttaaacgttacgtaacggtcgaactacgtacttactaacgttcgtaac

SEQ ID NO: 352484 - DNA, 575 bp, Homo sapiens
  misc_feature: GZ8MTXP01AEGBK.15.3.A03.1.454.CMB.2.raw
  modified_base (229)..(229): a, c, t, g, unknown or other
  misc_feature (229)..(229): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (443)..(443): a, c, t, g, unknown or other
  misc_feature (443)..(443): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctacaacaataagaactactagcttaggatacaagaaaaacagacagcctactaanctgctctatttacgnggcacgtccgtaacccgggtactcccgggggtcctacggaccgtattcccgaggtggaccgagggtccgggtcgtcgggccagacgtactttccactctcaacctatcacgtcacgcccttgaccaggctaggaacgtntggtagtacttagggtttattacgtgtacaggctaaatatagtaaagttctttactttacgtcggtaaccgtgaacctaagttcgtaatacgttagaaacgttatggtagtcgtcacgactaagttcgttcg

SEQ ID NO: 352485 - DNA, 643 bp, Homo sapiens
  misc_feature: GZ8MTXP01B50FA.15.3.A03.1.454.CMB.2.raw
  modified_base (231)..(231): a, c, t, g, unknown or other
  misc_feature (231)..(231): n is a, c, g, or t
  modified_base (315)..(315): a, c, t, g, unknown or other
  misc_feature (315)..(315): n is a, c, g, or t
  modified_base (459)..(459): a, c, t, g, unknown or other
  misc_feature (459)..(459): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgtttanacagctaccaacaaataagtaactacttagcttaggactacaagaaaaaccaggacagcctacctaagctgctactatttacgngggacagtacccgtaacccgggtacgtccccgggggtccctaggaccgtacttcccgaggtggaccgaggcggggtactgggcactagtactttccacttcctacaaccctatccaggcacgcctggacgaggctaggaaacgntggtagtaccttaggtttaattacgtggtacaaggtactaaattagttaagtaaacgttttcttttaccccgttttacgttcccgggtaacccgtaaggggttaaacctaaaggttggtaaacttattaccggttaaaacgttacgtgggtacgcttcgaacgttaccttaacttcgttaaccg

SEQ ID NO: 352486 - DNA, 647 bp, Homo sapiens
  misc_feature: GZ8MTXP01CODWO.15.3.A03.1.454.CMB.2.raw
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgttttatacagctaccaaacaaataaagaactacttagcttaggatacaagaaaaaccnggacagcctactaagctgctctattacnggacatccgtacccgggaacgtcccggggtcctggaccgtattcccgaggtcggacgtacggcgggtctgggcacgagtctttcactctcacctatcaggtcagcctgacgacggctaggaagacttggtaggtacttaaggggtttattaccgtggtacaaggtactaaattagttaagtaaaacgtttctttaccccgttttaagttcccgggaaccccgttaaggggaaaccccttaaagggttcggtaaaacttacgttaaaccggaaaaaccggttaacgttggggtaacgtcccgtacggaccttaaccccttaagttccctttaacgg

SEQ ID NO: 352487 - DNA, 632 bp, Homo sapiens
  misc_feature: GZ8MTXP01DL1YZ.15.3.A03.1.454.CMB.2.raw
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (443)..(443): a, c, t, g, unknown or other
  misc_feature (443)..(443): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacgggccaccatcaactgacaagtccagccagtagttgtttanacagctaccaaacaataagaactatagcttagatacaaagaaaaaccagacacgcctacaagctgctctattacgnggcacgtaccgtaacccgggaacgtccccgggtccacgaccgtattacccgaggtcggcgacggccgggtctgggccaatagtactttccactctaccaaccatcaacgcacgcctgcgagtctaggaaangtggtagtacttaaggtttaattacgtgtacaagtactaaattagtaaggttaaaactttctttccctttttaacggtcccgggtaacccttaaggggaaacctttaaaagggttcgtaaactaacttaaacccggaaaacgttacgttgggttacgcgttcgaaccttaccgtaactttccgttaacg

SEQ ID NO: 352488 - DNA, 592 bp, Homo sapiens
  misc_feature: GZ8MTXP01A1EZ6.15.3.A03.1.454.CMB.2.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (323)..(323): a, c, t, g, unknown or other
  misc_feature (323)..(323): n is a, c, g, or t
  modified_base (425)..(425): a, c, t, g, unknown or other
  misc_feature (425)..(425): n is a, c, g, or t
  modified_base (451)..(451): a, c, t, g, unknown or other
  misc_feature (451)..(451): n is a, c, g, or t
  modified_base (581)..(581): a, c, t, g, unknown or other
  misc_feature (581)..(581): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagtagttgtttanacacgctaccaaanaaataagaactacttagcttaggatacaacgaaaaaaccaggaacacgaccctacctaagctagctactatttacgnggtctacgtaccgtaacccgggtaacgttcccggggtccctacgaccgtattccgaggtggacgacggcggtactgggcacgtagtacttcactctacaccntcagcagcctgacgagctagaacgtntggtgtactaaggtttatacgtgtacagtataatagtaagtaaacgtttctttacctttacgttaccggccttaagggacctaaagttggaatacttaacgaacgttacgtggtacgtcacgtcaccgtnttcgttaaccg

SEQ ID NO: 352489 - DNA, 622 bp, Homo sapiens
  misc_feature: GZ8MTXP01AWIQ2.15.3.A03.1.454.CMB.2.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (320)..(320): a, c, t, g, unknown or other
  misc_feature (320)..(320): n is a, c, g, or t
  modified_base (432)..(432): a, c, t, g, unknown or other
  misc_feature (432)..(432): n is a, c, g, or t
  modified_base (461)..(461): a, c, t, g, unknown or other
  misc_feature (461)..(461): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggccaccatcaactgcaagtccagccagagttgtttanacagctaccaaanaataagaactacttagcttaggatacaaagaaaaaccaggacacgcctacctaagctgctactaatttacgngggactacgtacccgtaaccccgggggaacgtcccgggggtccctaggaccgtattcccgaggtcggcgaggccggtctgggcagacgtactttcactcctacaccatcgancgacgcctgaccaggtctagaagtatggngtacttagggtttactacgttgacaagtactaaatagttaacgtaacgtttctttacccgttttacgtcccggaacccgttaggggaaacctaaaggttcggtaaattacgttaaccgttaaaggaccttgggtacgcttcggaccaaccttgttctttcg

SEQ ID NO: 352490 - DNA, 538 bp, Homo sapiens
  misc_feature: GZ8MTXP01E3R8I.15.3.A03.1.454.CMB.2.raw
  modified_base (228)..(228): a, c, t, g, unknown or other
  misc_feature (228)..(228): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
  modified_base (521)..(521): a, c, t, g, unknown or other
  misc_feature (521)..(521): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaacaataagaactacttagcttggatacaagaaaaaaccaggacagcctcctaagctagctcatttacnggcatctacccggaatccgggtccngacgattcagtgcagcggaatgngacanagtctacactcaccactcagacacnctcgagacgacgngtaagatgtagcgtatttagtttactgttgacganaatatagtaagtacttttactttcctttacgtcccggtaggttacgtaaacgttaggtaactaattacaacgaacgtaagtggtcgtcncgacctaacgttcttcg

SEQ ID NO: 352491 - DNA, 564 bp, Homo sapiens
  misc_feature: GZ8MTXP01BC2S2.15.3.A03.1.454.CMB.2.raw
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaacaataagaactacttagcttggatacaagaaaaaaccaggacagcctacctaagctgctcatttacngggcagtccgtacccgggaagtcccggggtccctgaccgattccaggtgcaggcggtcnggcangtattcactctacacatcagcacgcctgcgaggctagaagatggtgtactagggtttatacgtgtacagactaattataaggtaaactttactttcccttttacgtttccgggaaccccttagggaacctaaaggttcggtaactaattaccgaaacgttacgtgtggcctagccttaccgtaattcttccg

SEQ ID NO: 352492 - DNA, 604 bp, Homo sapiens
  misc_feature: GZ8MTXP01B2GI3.15.3.A03.1.454.CMB.2.raw
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctaccaacaaataagaactacttagcttgatacaagaaaaaccnggacagcctactaagctgctctatttacngggcatcccgtacccgggaagtcccgggggtccctgaccgtattccgaggtggcaggtcgggtctcgggcacagtactttcactctccaccatcagctagcctgcaggctagaagtgtggtgacgttaggtttacttacgtcgtacacgtactaaagttaattaaaccgaagttcggacccttaacgtttccctaaccggttttccggacccgtaaacgggttaccgtaaaaggtgggttaacttacgaaaccgtaaacgtagtaacggtacgtcgaccgtaacccttcgtttaaccg

SEQ ID NO: 352493 - DNA, 738 bp, Homo sapiens
  misc_feature: GZ8MTXP01DTFZI.15.3.A03.1.454.CMB.2.raw
  modified_base (473)..(473): a, c, t, g, unknown or other
  misc_feature (473)..(473): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgccgtacggggacatcgtgatcgacccagtctccagactccctggctgtgtctcgtgggcgaggacgggccaccatcaaactgacaacgtccagccgagtagttgtttttaacacacgtcctaccaaactaaataaagtaacctacttagtcttaggataacgaaagaaaaaaccaggaacacgtccctactaagctgtactactaatttacgcgggactaacgtacccgtaaccccgggggtaacgttccccgggggttaccctacggtaacccgtagtttccccggaggtacgggacgaggggtcccggggttacgagggccaaacgtacgttactttaccnccttacgtacaacctactcgacgacacgcccgtgaccgtaggacaggaacgtagtggtacgtacgtttaagggtttacttacgtcgtacgtataacgtaaattaaggttaaggttaaactttaccgttttacccgtttttaacggttcccgggtaacccggttaacggggaaaacccgttaaagggttaggttaaacttaacgaaccgttaaaaccggttagttcgggtaacgggtctacggtcccaaacccgtttcttccgttc

SEQ ID NO: 352494 - DNA, 719 bp, Homo sapiens
  misc_feature: GZ8MTXP01DT9K1.15.3.A03.1.454.CMB.2.raw
  modified_base (233)..(233): a, c, t, g, unknown or other
  misc_feature (233)..(233): n is a, c, g, or t
  modified_base (267)..(267): a, c, t, g, unknown or other
  misc_feature (267)..(267): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccatcaactgacaagtccagccagtagttgtttanacagctacaacaaataagaactatagcttgtaanacaaagaaaaaccaggacacgaccctactaagctgcttatacgtttacgtgggactacgtacccggtaacccgggtaacggttccccgggggttcccctacggacccgtacgttaccgaggtcggacgacgggtccgggtcgtacgggcaacgtagttactttaccacctctacacctatccgaacgcacgtcctaggaccgtagggtctaaggaagtagttggtacggtacctttaaggggttttacttaacggtcgttaccgaaacgattaaaagtttgtaaaaggtttaaaccgtttacttttttaaccccggttttaccgtttccccggggtaacccgtttaaacgggggaaaccctttaaaaggggttccgtaaaatttcgttaaaacccgttaaacggttaccgttgggtaacgcgttacgaccttaaccgttcttcgtttaaccg

SEQ ID NO: 352495 - DNA, 722 bp, Homo sapiens
  misc_feature: GZ8MTXP01ETZXW.15.3.A03.1.454.CMB.2.raw
  modified_base (231)..(231): a, c, t, g, unknown or other
  misc_feature (231)..(231): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccacatcaactgcaagtccagccagagttgttttanacagctaccaaacaaataagaactactagcttgaatacaaagaaaaaccaggacacgcctactaagctgctctatttacgtgggactactaccgtaacccgggaacgtcccgggggtaccctcggacccgtagttcccgaggtcggcgacggtccggggttacctgggcctaacgtacgttaactttccaaccttctaccaacctactcgacgcacgccgttgaccgaggggtacctaggaaaagtgttaggttacgggtactttaaggggttttaactttaccgtaggttacaaggtacctaaagtttaagtaacggttaaacgttttacctttttaccccgttttaaaccgggtttcccgggtaacccccggtttaaggggttaaaccctaaaaggggttaggtaaactttaaacgttaaaccgaaaacgggtttaaccgtggggtagggtaacccttccggaaccttacgttaactttcggtttcccg

SEQ ID NO: 352496 - DNA, 625 bp, Homo sapiens
  misc_feature: GZ8MTXP01EXZM9.15.3.A03.1.454.CMB.2.raw
  modified_base (454)..(454): a, c, t, g, unknown or other
  misc_feature (454)..(454): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgtttatacagctaccaacaaataagaactacttagcttggatacaagaaaaaccaggacacgcctacctaagctagctctatttacgtgggactacgtacccgtaacccggggtaacgtcccgggggtccctagacccgtattccccgaggtcggcgaggtccgggtctcgggcacagtactttcacttctccacctatcgaagcagccctgaccgaggtctagaaagntggtagcttaagggttttacttacgtgttacaagtactaaatagttaagtaaatttcttttccttttaaccggttcggtaaccccgttaagggaaacctaaaggttacggaaattaacggttaacaaaacgttacgttggcggtaactgccttacctaatttccgttaacg

SEQ ID NO: 352497 - DNA, 605 bp, Homo sapiens
  misc_feature: GZ8MTXP01BHC57.15.3.A03.1.454.CMB.2.raw
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
  modified_base (330)..(330): a, c, t, g, unknown or other
  misc_feature (330)..(330): n is a, c, g, or t
  modified_base (478)..(478): a, c, t, g, unknown or other
  misc_feature (478)..(478): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
  modified_base (599)..(599): a, c, t, g, unknown or other
  misc_feature (599)..(599): n is a, c, g, or t
  modified_base (605)..(605): a, c, t, g, unknown or other
  misc_feature (605)..(605): n is a, c, g, or t
tcagtctacgtagccacgaccggtgctcgatttagagagcgtcacgagggggctacaacaggcaggcaggggcagcaagatggtgttgcagacccaggtcttcatttctctgttgctctggatctctggtgccgtacggggacatcgtgatcgaccctagtcctccagacctcccgtggctgtgtctcgtgggcgaggacgggcccacatcaactgactaacgtccagccagtagttgttttaanacagcctacaaacaaataaagaacttatagcttgaataacaaacgaaaaaccnggacacgccctacaagctgctctaatttacgnggactacgtcccgtaacccgggtacgtcccggggtccctagaccgtatccgaggtggcgacggtccgggtctacgggcaacgtagttacttcctactcgtcaaaccctgacaaggtcacgccctaggaccaggtctagaagtctaggngtacttaggtttacgtactgtacagtacaagttataagtaaactttctttaccgtttacgtccgggaacctaggacctaaaggttcgaatacttagaaacgnttggcncgtacncttactnttcgtn

SEQ ID NO: 352498 - DNA, 660 bp, Homo sapiens
  misc_feature: GZ8MTXP01BIHWU.15.3.A03.1.454.CMB.2.raw
  modified_base (640)..(640): a, c, t, g, unknown or other
  misc_feature (640)..(640): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttatacagctaccaaacaataagaactacttagcttaggatacaaagaaaaaaccaggaacacgccctacctaagctgcttactaactttacgtggggactacgtacccgtaaccccgggggtaacgttccccgggggttacccctacggtacccgtaactttacccgaggttcggaccgacgggtccggggttccgtcgggcaaccgtaagtacttttaccgacctctaccacctatcacggacacgccctggaccgaggactaggaacgtatggtagggtacttagggttttaattaccgtgtacagtactaaattacgttaagtaaattttaccttttaccttttacgttccggaaccctagggttaaacctaaaggttcgtaaatattaaccgaaagttactggtacgtnttgaccttaccttgttcgtg

SEQ ID NO: 352499 - DNA, 621 bp, Homo sapiens
  misc_feature: GZ8MTXP01BSGTB.15.3.A03.1.454.CMB.2.raw
  modified_base (230)..(230): a, c, t, g, unknown or other
  misc_feature (230)..(230): n is a, c, g, or t
  modified_base (315)..(315): a, c, t, g, unknown or other
  misc_feature (315)..(315): n is a, c, g, or t
  modified_base (409)..(409): a, c, t, g, unknown or other
  misc_feature (409)..(409): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaaataaagaactacttagcttggatacaagaaaaaaccaggacagcctacctaagctcgctactatttacgnggctatccgtaacccggaatccggggtaccctgaccgattcagtgcacggcgggtctgcgacaagtactttcactctcaccatcagcacgtccngacgaggtctagaaacgtatggtagggtacctaagggttttaacttacgtaggttacctaagacctaaattacttaaggtaaaagtttccttttaccctttttaacgttcccgggtaaccctagggttaaacccgtaaaagttgggtaaattaacttaaccgaaaacggttaactttgggacggtcctacgaccactaacgttctttaacgg

SEQ ID NO: 352500 - DNA, 732 bp, Homo sapiens
  misc_feature: GZ8MTXP01A76B2.15.3.A03.1.454.CMB.2.raw
  modified_base (236)..(236): a, c, t, g, unknown or other
  misc_feature (236)..(236): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgccgtacggggacatcgtgatgacccagtctccagacctccgtggctgtgtctcgtgggcgaggacgggccacatacaactgacaagtccagccagtagttgtttanacagctaccaaactaaataaacgtaacttacttagtacttaggtaactaacaaacgaaaaaaccgaggaacacgacctactaagctagtctactactttacgcggactacgtacccgtaacccgggtaacggtcccgggtaccctacggaccgtacgttaccgaggtcggacgacgggtccggtcgtacggcaacgtacgttactttaccaccttacctaccaaccgtactacgacgaccgaccgtcccgtaggaaccgtacggacttaaggaaagtcgttagggtcggttaacctttaacggggttttataccgtacggtactaacggtaacttaaagtttagttaaacggtttaacttttaccgtttttacccgttttaccggtcccgggtaacccgtagggttaaacctaaggttagtaaacttaacgttaacgttaaaaccgttcggttgggtccgtaacgttaccaccgttaaccctttcgtttccgttcg

SEQ ID NO: 352501 - DNA, 790 bp, Homo sapiens
  misc_feature: GZ8MTXP01BC20N.15.3.A03.1.454.CMB.2.raw
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccagtcaaactgcaagtccagccagagttgttttatacagctaccaacaaataagaacttactagtcttaggatacaagaaaaaaccaggacagtccctaccgtaagcctagcctactattttaccgtggggacctacgtacccgtaaccccgggggtaaacgttccccgggggtacccctaggaaccccgtagtttacccccgaaggttcgggcgtaacggtccggggttcgtacgggccaaccgagggttaaacttttcccaacttccttacccaaaccctaaacgttccaaacggcccaaacgggtcccccgttaggaacccagggggtaccttagggaaaagtagttcggtaggggtacccttaggggtttttaaactacgtttacggtacccgaaggtacctaaagttaacgttaacgggtaaaaagttttccttttacccgtttttaccgtttcccggggtaacccccgttagggggaaaccccttaaagggttggtaaacttttaacgacccgggttaaaaaaacccttcggttaaggtaccgggccctttagggacccttaaaccctaaggttcccctttaacgg

SEQ ID NO: 352502 - DNA, 636 bp, Homo sapiens
  misc_feature: GZ8MTXP01DBPB3.15.3.A03.1.454.CMB.2.raw
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaaccatacaactgcaagtccagccagtagtgtttanacagctaccaanaaataagaactacttagtcttaggtatacaagaaaaaaccaggacagtcctacctaagctgctctattacgtggtacactccgtaacccgggaacgtcccgggtccctaggaccgtattccgaggtgacaggcggtactgcacagtactttcactctcacatacagcagcctgacgtaggctaaggaagagtggtaggtacttaggtttattactgtacgagtactaaagtagttaagtaaacgttacttttacccttttacgtttcccgggtaaccccgttaaggggttaaaccgtaaaaggttcgggtaaacttaaacgttaacccgttaaaacgttaacggtttcggtaagggtccttggaccttaaccgtaacgtttcccttaaccg

SEQ ID NO: 352503 - DNA, 605 bp, Homo sapiens
  misc_feature: GZ8MTXP01ETXLM.15.3.A03.1.454.CMB.2.raw
  modified_base (180)..(180): a, c, t, g, unknown or other
  misc_feature (180)..(180): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (419)..(419): a, c, t, g, unknown or other
  misc_feature (419)..(419): n is a, c, g, or t
tcagtctacgtagccacgaccggtgctcgatttagagagcgtcacagggggctacaacaggcaggcaggggcagcaagatggtgtgcagacccaggtcttcatttctctgttgctctggatctctggtgcctacgggacatcgtgatgacccagtctccagactcctggctgtgtctcgngggcgagagggccacatcaactgcaagtccagccaagagttcgttttanaacngcttaccaaacaaagtaaagaactacttagcttaggatacaanaaaaaacnggaactagacctcgtaanctgctcaatttanggcatcgtaacccggatccgggtaccnggacccnttccgaggtgacgagtcggggtcacggcaacagtacttttacaccgttcacacctagtcaagccagtccngacgacgacgagagtagtcgtagtagtagttattactacgtacataataattaagttaagttaaacgtttaactttaccgttttaccgttccgttccgtaacggttaaacgtaaacgttaagtaaagtaacttaacgttaaacgttaacgtaagtagtaacgtacgtacttacctaacgttcgtcg

SEQ ID NO: 352504 - DNA, 502 bp, Homo sapiens
  misc_feature: GZ8MTXP02FU3ZT.15.3.A03.1.454.CMB.2.raw
  modified_base (227)..(227): a, c, t, g, unknown or other
  misc_feature (227)..(227): n is a, c, g, or t
  modified_base (303)..(303): a, c, t, g, unknown or other
  misc_feature (303)..(303): n is a, c, g, or t
  modified_base (435)..(435): a, c, t, g, unknown or other
  misc_feature (435)..(435): n is a, c, g, or t
  modified_base (498)..(498): a, c, t, g, unknown or other
  misc_feature (498)..(498): n is a, c, g, or t
tcagtctacgtagccacgaccggtgctcgatttagagagcgtcacaggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctccaaacaataagaactacttagcttggtatcaagaaaaaccaggacagcctactaagctgctcatttacnggcatctacccggaatcccgggtcctgaccgattccagtgcagcggtctggcacagtatttcactctcaccatcagcagcctgcaggctgaagatgtggctagtttatactgtcagcaaatatagtaaaatntttacctttacttcggccctgggaaccaaaggtgatactacaaacgaactgtggctgcaactntctg

SEQ ID NO: 352505 - DNA, 531 bp, Homo sapiens
  misc_feature: GZ8MTXP02FZUGJ.15.3.A03.1.454.CMB.2.raw
  modified_base (227)..(227): a, c, t, g, unknown or other
  misc_feature (227)..(227): n is a, c, g, or t
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
  modified_base (444)..(444): a, c, t, g, unknown or other
  misc_feature (444)..(444): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgtttanacagctccaaacaataagaactacttagcttggtatcaagaaaaaccaggacagcctacctaagctgctcatttacnggcatccgtacccgggatcccggggtccngaccattccagtgcagcggtctggcanagtatttcactctcaccatcagcacgcctgcaggctagaagatggtgctagtttatactgtacagcaaatatagtaaaacgttntttcccttttacgttccggaccttcggggaaacctaaagttggaattacgtaacaaacgtactggacgtcgtagccaacctatctcg

SEQ ID NO: 352506 - DNA, 507 bp, Homo sapiens
  misc_feature: GZ8MTXP02GVI8D.15.3.A03.1.454.CMB.2.raw
  modified_base (303)..(303): a, c, t, g, unknown or other
  misc_feature (303)..(303): n is a, c, g, or t
  modified_base (434)..(434): a, c, t, g, unknown or other
  misc_feature (434)..(434): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttacnggcatctacccggatccggggtcctgaccgattccagtgcagcgggtctgggcacagatttcactctcaccatcagcagcctgcaggctgaagatgtggctagtttatactgtcagcaatatgaaaagttntttaccttttacttcggcccttagggaacctaaaggtggaactactacaaacgactgtgactgcaccatctcg

SEQ ID NO: 352507 - DNA, 597 bp, Homo sapiens
  misc_feature: GZ8MTXP02GDVID.15.3.A03.1.454.CMB.2.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (340)..(340): a, c, t, g, unknown or other
  misc_feature (340)..(340): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacaataagaactacttagcttggtatcaagaaaaaccaggacagcctacctaagctgctcatttacnggcatctacccgggaatcccggggtcctgaccgtnttccagtgcagcggtctggcacagtatttcactctcacatcagcagccctgcaggctagaagagtgtaggctagtttatacgtgtacagacaagttatagtaaaagttactttacccgttttacgtttcccggtaccccgttaggggaaaacccttaaaagggttacgggtaattaaacgttaacccgaaaacggtaaaccgttaaggtttacggggaccttacggaacccgtaaccctagtttaaccccgtttacg

SEQ ID NO: 352508 - DNA, 588 bp, Homo sapiens
  misc_feature: GZ8MTXP02G3AEI.15.3.A03.1.454.CMB.2.raw
  modified_base (228)..(228): a, c, t, g, unknown or other
  misc_feature (228)..(228): n is a, c, g, or t
  modified_base (336)..(336): a, c, t, g, unknown or other
  misc_feature (336)..(336): n is a, c, g, or t
  modified_base (363)..(363): a, c, t, g, unknown or other
  misc_feature (363)..(363): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacaactccaacaataagaactacttagcttggtatcaagaaaaaccaggaacagcctacctaagcctgctcatttactggcatcgtacccgggaatcccggggtcccngaccgattcagtgcagcgggtctggcncagatttcactctcaccatcagcagcctgccaggctagaagatgtgacttagtttatactgtacagacaaatataggtaaattctttccttttaacgttccgggtacccccttagggggtaaacccctaaaagggttcggtaaattaaacgttaccgaaaaaaccggtaccgtttagggtaacgggtacccttggacctaccctaagtttcctaacggtttaccc

SEQ ID NO: 352509 - DNA, 542 bp, Homo sapiens
  misc_feature: GZ8MTXP02IGYNB.15.3.A03.1.454.CMB.2.raw
  modified_base (309)..(309): a, c, t, g, unknown or other
  misc_feature (309)..(309): n is a, c, g, or t
  modified_base (414)..(414): a, c, t, g, unknown or other
  misc_feature (414)..(414): n is a, c, g, or t
  modified_base (453)..(453): a, c, t, g, unknown or other
  misc_feature (453)..(453): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaaacaataaagaactacttagcttggtatcaagaaaaaaccaggacagcctacctaagctgctcatttacnggcatccgtacccgggaatcccggggtccctgaccgattccagtggcaggcgggtctggcacagtatttccactctcaccatcagcagcctgcaggctagaaagntgtggctagtttattactgtcagcaatatagtaaagttntttaccgtttacttccggacccttagggaacctaaaggtaggaattacgtaaccgtaaacgaactgtacggctacgactacctatctcg

SEQ ID NO: 352510 - DNA, 518 bp, Homo sapiens
  misc_feature: GZ8MTXP02H53GE.15.3.A03.1.454.CMB.2.raw
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
  modified_base (397)..(397): a, c, t, g, unknown or other
  misc_feature (397)..(397): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataagaactacttagcttggtatcaagaaaaaaccaggacagcctcctaagctgctcatttacnggcatctacccggatccgggtcctgacgnttccagtgcagcggtctgcacagtatttcactctacaccatcagcagcctgacaggctgaaagntgtaggctagtttattactgtcagacaatatgaaagttactttacctttacgtttccggcccttaggggaacctaaaagtggaatactacgaaacgaactgtggactcgacaccattcctg

SEQ ID NO: 352511 - DNA, 576 bp, Homo sapiens
  misc_feature: GZ8MTXP02IY4D8.15.3.A03.1.454.CMB.2.raw
  modified_base (231)..(231): a, c, t, g, unknown or other
  misc_feature (231)..(231): n is a, c, g, or t
  modified_base (320)..(320): a, c, t, g, unknown or other
  misc_feature (320)..(320): n is a, c, g, or t
  modified_base (437)..(437): a, c, t, g, unknown or other
  misc_feature (437)..(437): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgacaagtccagccagtagttgttttanacagctaccaaacaataagaacttacttagcttaggtaatacaaagaaaaaaccaggaacagccctacctaagctgctctaatttacgnggcagtccgtacccgggaatcccggggtcctggaccgtattccgaggtgcgaggcggtctgggccacagtactttccactctacaccctatcagcacgccctgcgaggctagaaagngtggtagacttaagtttacttacgtagtcaagactaaatagtagtaaactttctttacctttacgtccgtacgtaggtaacctaagtcgaatacgtacgaaacgtactggtacggtactacgactaacctcttacgtcg

SEQ ID NO: 352512 - DNA, 589 bp, Homo sapiens
  misc_feature: GZ8MTXP02IWJSN.15.3.A03.1.454.CMB.2.raw
  modified_base (229)..(229): a, c, t, g, unknown or other
  misc_feature (229)..(229): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctaccaaacaataagaactacttagcttggtatcaaagaaaaaaccaggacacgcctacctaagctgctcattactggcatcgtacccgggaatccggggtcctgaccgatccagtgcagcggtcngcanagtattcactctacacatcagcacgcctgacaggctagaaagagtggtaggacttagtttacttacgtgtacagactaaattatagtaaaacgtttctttacccgttttacgttaccgggtaccccttaggggaaaccctaaagggtacggaaatttaacgtaaacccgtaaaacgtaaccgttaaggtcgggtaccttacggaccctaacctaagtcctttacgg

SEQ ID NO: 352513 - DNA, 505 bp, Homo sapiens
  misc_feature: GZ8MTXP02JAM3L.15.3.A03.1.454.CMB.2.raw
  modified_base (303)..(303): a, c, t, g, unknown or other
  misc_feature (303)..(303): n is a, c, g, or t
  modified_base (441)..(441): a, c, t, g, unknown or other
  misc_feature (441)..(441): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataagaactacttagcttggtatcaagaaaaaccaggacagcctcctaagctgctcatttacnggcatctacccgggaatccggggtcctgaccgattccagtggcagcgggtctggcacagtattcactctcaccatcagcagcctgcaggctagaagtatgtggactaggtttattactgtcagcaaatatgaaaattnttacctttacttcggaccttgggaaccaaagtgactatacaaacgactgtgctgacacatctag

SEQ ID NO: 352514 - DNA, 513 bp, Homo sapiens
  misc_feature: GZ8MTXP02HVETJ.15.3.A03.1.454.CMB.2.raw
  modified_base (239)..(239): a, c, t, g, unknown or other
  misc_feature (239)..(239): n is a, c, g, or t
  modified_base (299)..(299): a, c, t, g, unknown or other
  misc_feature (299)..(299): n is a, c, g, or t
  modified_base (392)..(392): a, c, t, g, unknown or other
  misc_feature (392)..(392): n is a, c, g, or t
  modified_base (419)..(419): a, c, t, g, unknown or other
  misc_feature (419)..(419): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaanaataagaactactagctggtatcagaaaaaccaggacagcctcctaagctgctcattacnggcatctaccgggaatccggggtcctgaccgatccagtgcagcggtctggcacagatttcactctcaccatcagcagcctgcaggctgaaagntgtggctagtttattactggtacaganaatatagtaagttattactttacgttacgtaccgtacgtacgtaacgtagtactactactaacgaacgtaagtcgacgtacacactactactcg

SEQ ID NO: 352515 - DNA, 553 bp, Homo sapiens
  misc_feature: GZ8MTXP02IKKA3.15.3.A03.1.454.CMB.2.raw
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (410)..(410): a, c, t, g, unknown or other
  misc_feature (410)..(410): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaacaataagaactacttagcttggtatcaagaaaaaccaggacagcctactaagctgctcatttacnggcatcgtacccgggaatcccggggtccctgaccgnttccagtggcagcgggtctgggcacagtactttccactctcacccatcagcagcctgcaggctgaaagntgtggctagtttatactgtcagcaatanagtaaagttntttacctttacgtttccggacccgttaggggaaaccctaaaggttacggaattacgtaaacgaaacgtaaacgtggtacggcttacgacctaacctattacttcg

SEQ ID NO: 352516 - DNA, 528 bp, Homo sapiens
  misc_feature: GZ8MTXP02HEOMP.15.3.A03.1.454.CMB.2.raw
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataagaactacttagcttggtatcaagaaaaaccaggacagcctacctaagctgctcattactggcatctacccgggaatccggggtcctgaccgatccagtgcaggcggtctggcacagactttcactctcaccatcagcagccctgcaggctgaagatgtgctagtttattactgtacagactaaatatagtaaagttactttaccgttttacgttccggtacccgtgggtaaaccctaaagtcggaatacgtacaaacgtaacgtgtacggctacgcacatctcg

SEQ ID NO: 352517 - DNA, 555 bp, Homo sapiens
  misc_feature: GZ8MTXP02FUHL9.15.3.A03.1.454.CMB.2.raw
  modified_base (303)..(303): a, c, t, g, unknown or other
  misc_feature (303)..(303): n is a, c, g, or t
  modified_base (441)..(441): a, c, t, g, unknown or other
  misc_feature (441)..(441): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctcaacaataagaactacttagcttggtatacaagaaaaaccaggacagcctcctaagctgctcatttacnggcatctacccggatccggggtcctgaccgattccagtggcagcgggtctggcacagtatttcactctcaccatcagcagcctagcaggctagaagatgtggctagtttatactgtacagactaatatagtaaaattntttaccttttaacgtttccggaccccgtaggggaaaccctaaaaggttcggaattaactaaccgaaaacgtaaaacgttggtcggaccgttacgacctaacctacttcgttacg

SEQ ID NO: 352518 - DNA, 613 bp, Homo sapiens
  misc_feature: GZ8MTXP02JA5VN.15.3.A03.1.454.CMB.2.raw
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
  modified_base (424)..(424): a, c, t, g, unknown or other
  misc_feature (424)..(424): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttaanacngcctaccaaacaataagaactacttagcttggtatcaagaaaaaccaggacagcctaccaagctgctcatttacngggcactaccgtacccgggagtcccggggtcctgaccgtattccgagtggcaggcgggtctgggcacgagtattcgactctacaccatcagcagccctgcgacggctaggaaagngtggtaggtacttaggttttactttacgtgttaccaagactaaattagtagtaaaacgtttacttttacccgttttaacgtttcccgggtacccgttagggtaaacccgtaaaagggttacggtaaattaacgtaaaccgaaaacgttaaacgtggtacggtactcggacctaaccgtacttactttcg

SEQ ID NO: 352519 - DNA, 583 bp, Homo sapiens
  misc_feature: GZ8MTXP02FX7L9.15.3.A03.1.454.CMB.2.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (380)..(380): a, c, t, g, unknown or other
  misc_feature (380)..(380): n is a, c, g, or t
  modified_base (446)..(446): a, c, t, g, unknown or other
  misc_feature (446)..(446): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataagaactactagcttggatcaagaaaaaccnggacagcctactaagctgctcatttacnggcactcgtacccgggaatcccggggtcctgaccgatccagtggcagcggtctggcacagatttcactctcaccatcancagcctgcaggctagaagatgtggactagtttactactgtacagtacaattagtagtaaaacgttntttaccccgtttttaagttcccgggtaccctagggggtaaaccctaaaagggtagggtaaacttaacgttaaccgaaaacgtaaaccgttggtacgggtaccttacggacctaaaacccgttacgttaccgtttacg

SEQ ID NO: 352520 - DNA, 554 bp, Homo sapiens
  misc_feature: GZ8MTXP02HGPCZ.15.3.A03.1.454.CMB.2.raw
  modified_base (432)..(432): a, c, t, g, unknown or other
  misc_feature (432)..(432): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaaacaataagaactacttagcttaggtatacaagaaaaaccaggacagcctacctaagctgctctattactggcatccgtacccgggaatcccgggtcctgaccgtattccgagtggcaggcggtctgggcacagtactttcactctcaccatcagcagcctgcaggctagaagatgtgcttagttattacgngtacagtcaatacgtagtaaacgttactttccgttttaacgtccgtacccgttagggaacctaaagtcggtaactacgtacaaaacgtacgtggtacgtctacgactaccgtagttccttag

SEQ ID NO: 352521 - DNA, 537 bp, Homo sapiens
  misc_feature: GZ8MTXP02HMLHD.15.3.A03.1.454.CMB.2.raw
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagttgtttanacagctaccaaacaataagaactactagcttggtatacaagaaaaaaccaggacagcctacctaagctgctnattactggcatccgtacccggaatccgggtcctgaccgattccagtgcagcggtctggcanagtattcactctcaccatcagcagcctgcagctagaagatgtggcttagtttattacgtgactagactaatataggtaaattctttacttttaacgttccggtaccgttaggggaacctaaagtcggtaataacgtacctaaaacgaactggtgacttacgacacctattacttcg

SEQ ID NO: 352522 - DNA, 576 bp, Homo sapiens
  misc_feature: GZ8MTXP02JAHN4.15.3.A03.1.454.CMB.2.raw
  modified_base (229)..(229): a, c, t, g, unknown or other
  misc_feature (229)..(229): n is a, c, g, or t
  modified_base (276)..(276): a, c, t, g, unknown or other
  misc_feature (276)..(276): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacaataagaactacttagcttggtatcaagaaaaaccnggacagcctacctaagctagctcatttactgggcatcctacccgggaatcccggggtcctgaccgattccagtggcacggcggggttcngcacgagtacttcactcncacancgagcacgctgacgaggctaggaagtctggtaggtacttaagtttactagtcgtacaagactaataataagtaaagttactttaccgttttaccgtttaccggtacccggtacggtaaccgtaaacgtaggtaacgtaactaacgtaaacgtaacgtaacgtacgtacgtacgactactactacgtcg

SEQ ID NO: 352523 - DNA, 480 bp, Homo sapiens
  misc_feature: GZ8MTXP02FL0J5.15.3.A03.1.454.CMB.2.raw
  modified_base (173)..(173): a, c, t, g, unknown or other
  misc_feature (173)..(173): n is a, c, g, or t
  modified_base (221)..(221): a, c, t, g, unknown or other
  misc_feature (221)..(221): n is a, c, g, or t
  modified_base (299)..(299): a, c, t, g, unknown or other
  misc_feature (299)..(299): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
tcagtctacgtagccacgaccggtgctcgattagagagcgtcacaggggctacaacaggcaggcagggcagcaagatggtgttgcagacccaggtcttcattctctgttgctctggatctctggtgcctacggggacatcgtgatgacccagtctccagactccctggctgtntctctggcgagagccaccatcaactgcaagtccagccagagtgtttanacagctccaacataagaactacttagcttggtatcagaaaaaccaggacagcctcctaagctgctcattactgggcanctacccggaatccggggtccctgccgattccagtgcagcggtctggcacagattcactctcaccatcagcagcctgcaggctgaagatgtgcagttatactgtcagcaatatgaaatatcctttaacttcggccctggaccaaagtggactatcaaacgaactgtggctgcaccncnctcg

SEQ ID NO: 352524 - DNA, 566 bp, Homo sapiens
  misc_feature: GZ8MTXP02F9A8Q.15.3.A03.1.454.CMB.2.raw
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
tcagtctacgtagccacgaccggtgctcgatttagagagcgtcacagggggctacaacaggcaggcagggtcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaataagaactacttagcttggtatcaagaaaaaccaggacagcctactaagctgctctatttacnggcatccgtacccgggaatcccggggtccctgaccgtattccgagtggcaggcgggtctgggcacagtactttcactctacaccatcagcacgctgcagctagaagagtgtggacttaagtttacttacgtgtacagactaaatagtaagtaaatttactttccttttaacgttcccggaccgttacgggaaacctaaaggtgaaacttacgtaaccgaaacgtaactggtacggactacgaccacctagttcttacg

SEQ ID NO: 352525 - DNA, 572 bp, Homo sapiens
  misc_feature: GZ8MTXP02JAUE3.15.3.A03.1.454.CMB.2.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (394)..(394): a, c, t, g, unknown or other
  misc_feature (394)..(394): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttatacagctaccaacaataagaactacttagcttggtatacaagaaaaaaccnggacagcctacctaagctgctcatttacnggcatcgtaccgggaatcccgggtcctgaccgtatcccgagtggcaggcggtctggcacagtatttcactctacaccatcaaggtccncgactgacgagacagaagtgtaggtacgtacttaagtttctatgacaagtactaaattagtaagttaactttacttttaccgtttacgtccggtacgtacggaaactaaggtacgttaactaaccgtaacgaaacggttaacgtcggtacgtactacgtacctacctacttacttacg

SEQ ID NO: 352526 - DNA, 624 bp, Homo sapiens
  misc_feature: GZ8MTXP02JB8ZU.15.3.A03.1.454.CMB.2.raw
  modified_base (240)..(240): a, c, t, g, unknown or other
  misc_feature (240)..(240): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (406)..(406): a, c, t, g, unknown or other
  misc_feature (406)..(406): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctcaagactccctggctgtgtctctgggcagaggccaccatcaactgcaagtccagccagagttgtttatacagctaccaaanaataagaactatagctagtatacaaagaaaacagacacgtcctacaagctnctactattacgnggacactaccgtaccggtacgtcccgggtacctacgaccgtatcccgagtcggcgacggcgggtcgtggcactagtacttcactctacgacctatacacgctnacgacgtcgacgacggcgtaggaagtacgtaggttacggtacgttagtttaacttacgtacgtacgtacgtaacgtaaacttaagttaacgttaaacgtttaacgtttacccgttttaacggtttaccggtacccggtacggtaaaccgtaaacggtacggtaacgtaactaacgtaaaacgtaacgtacggtacgtacgtacgtacctacctactcg

SEQ ID NO: 352527 - DNA, 532 bp, Homo sapiens
  misc_feature: GZ8MTXP02I6SCV.15.3.A03.1.454.CMB.2.raw
  modified_base (355)..(355): a, c, t, g, unknown or other
  misc_feature (355)..(355): n is a, c, g, or t
  modified_base (431)..(431): a, c, t, g, unknown or other
  misc_feature (431)..(431): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataagaactacttagcttggtatcagaaaaaccaggacagcctcctaagctgctcatttactggcatctacccggaatccggggtcctgaccgatccagtgcagcggtctgcacngattcactctcacatcagcagcctgcagctagaagatgtggctagtttattactgtctagcaatatgtaaaagttntttaccttttacgtttcggacccttagggaacctaaagttggaatacgttaacgaaaacgtaaacttggtacggacttacggactaacctaatcgtttacg

SEQ ID NO: 352528 - DNA, 547 bp, Homo sapiens
  misc_feature: GZ8MTXP02IK5V8.15.3.A03.1.454.CMB.2.raw
  modified_base (228)..(228): a, c, t, g, unknown or other
  misc_feature (228)..(228): n is a, c, g, or t
  modified_base (311)..(311): a, c, t, g, unknown or other
  misc_feature (311)..(311): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (426)..(426): a, c, t, g, unknown or other
  misc_feature (426)..(426): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactcctggctgtgtctctgggcgagagggccaccatcaactgcaagtccagccagagtgttttanacagctaccaaacaataaagaactacttagcttggtaatacaagaaaaaaccaggacagcctacctaaagctgctcatttacnggcatctaccgggaatccggggtcctgaccgattccagtgcagcggtcngcanagatttcactctacaccatcagcagcctgcaggctagaagatgtggtactagtttatttacngttacagacaataatagtaaagttaattactttactttacgtccgtacggtaccgtaaacgtaaggtaactaataactaaaacgtaaacgtaagtagtacgtacgacacctactacttacg

SEQ ID NO: 352529 - DNA, 525 bp, Homo sapiens
  misc_feature: GZ8MTXP02FLDP7.15.3.A03.1.454.CMB.2.raw
  modified_base (305)..(305): a, c, t, g, unknown or other
  misc_feature (305)..(305): n is a, c, g, or t
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttatacagctccaacaataagaactacttagcttggtatcaagaaaaaaccaggacagcctacctaagctgctcatttacngggcatcgtacccgggaatccggggtccctgaccgattcccgagtggcaggcgggtctgggcacagatttcactctcaccatcagcagcctgcaggctagaagatgtaggctagtttatactgtacagcaaattnagtaaaattntttacctttacgttcggcccttgggaacctaaagtcggaatacgtacaaacgtaatgtacgctacgcacatctcg

SEQ ID NO: 352530 - DNA, 542 bp, Homo sapiens
  misc_feature: GZ8MTXP02IHNIT.15.3.A03.1.454.CMB.2.raw
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaaacaataaagaactacttagcttggtatcaagaaaaaaccaggacagcctacctaagctgctcatttacngggcatctacccgggaatccggggtccngaccgattcccagtggcagcggtctgcacagatttcactctcacccatcagcagcctgcaggctgaanatgnggactagtttattaacgttntacagacaaataataacgaagtgactattactacgttccggaccgaacggaaaccaaaggtacgtaaactaacgaaacgtaaacgtacgtacggtacgactacgtacactacg

SEQ ID NO: 352531 - DNA, 589 bp, Homo sapiens
  misc_feature: GZ8MTXP02I65XP.15.3.A03.1.454.CMB.2.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccatctccagactccctggctgtgtctcgtgggcgagagggccaccatcaactgcaagtccagccagagttgtttanacagctaccaacaataagaactacttagcttggtatcaagaaaaaccaggacagcctcctaagctgctcatttacnggcatccgtacccgggaatcccggggtaccctgaccgattcccagtggacagcgggtctggcanagtattcactctcacatcancactcngcaggtcagacagtgngtactagtttactagtcgtacganactaataagtagtaaaacttctttaccttttacgtacccggtacccgtacggggaaacctaaagggtacgtaaacttaacgtaaaaccgtaaaacgtaaccttaaggggttcgttaccgtaacggcctaaaaccccttaggttccgtttaaccg

SEQ ID NO: 352532 - DNA, 549 bp, Homo sapiens
  misc_feature: GZ8MTXP02GAL2S.15.3.A03.1.454.CMB.2.raw
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaaacaataaagaactactagcttggtatacaagaaaaaccaggaacacgcctacctaagctgctctatttactggcatccgtaacccgggaacgtcccgggtccctagaccgattccgagtggcaggcggtctgcacagtattcactctcacatcagcacgctgcaggctagaagagtgtggactagtttattacgtgtacagtacaattataagaaagtttacttaccttttacgtcggtaccctagggaacctaaagtggataacgtaacaaacgtaacgtgtacggactacgaccacctagtctacg

SEQ ID NO: 352533 - DNA, 565 bp, Homo sapiens
  misc_feature: GZ8MTXP02IIE5J.15.3.A03.1.454.CMB.2.raw
  modified_base (404)..(404): a, c, t, g, unknown or other
  misc_feature (404)..(404): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaacaataagaactacttagcttggtatcaagaaaaaccaggacagcctactaagctgctcattactggcatcgtacccgggaatcccggggtacctggccgattccagtggcagcgggtctggcacagtattcactctcacatcagcagcctgcaggctgaaagntgtgactagtttattacgtgtacagtataaatataagaaagtttactttaccgtttttaaacgttccggtacccgtaggggtaaaccctaaaaggttcggaaattaacgtaactaaaaccgtactggttaggaccttcggacctacccgaatttcgttacg

SEQ ID NO: 352534 - DNA, 575 bp, Homo sapiens
  misc_feature: GZ8MTXP02J0UZM.15.3.A03.1.454.CMB.2.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (472)..(472): a, c, t, g, unknown or other
  misc_feature (472)..(472): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaacaataagaactactagcttggtatacaagaaaaaccaggacagcctcctaagctgctcatttacgnggcactccgtacccgggaagtcccggggtccctaggaccgtattccgagtggacacggcgggtactggccacagtactttccgactctacaccatcagcacgccctgcaggtctagaagtatgtaggctagtttactactgtacagactaatagtagtaaaacgttntttaccctttacgttcggtaccccgttagggaacctaaaggtcggaacttacgtaacgaaacgtacgtggtacggctacggtaccctaccgtatccgtttacg

SEQ ID NO: 352535 - DNA, 596 bp, Homo sapiens
  misc_feature: GZ8MTXP02GPHQA.15.3.A03.1.454.CMB.2.raw
  modified_base (228)..(228): a, c, t, g, unknown or other
  misc_feature (228)..(228): n is a, c, g, or t
  modified_base (275)..(275): a, c, t, g, unknown or other
  misc_feature (275)..(275): n is a, c, g, or t
  modified_base (585)..(585): a, c, t, g, unknown or other
  misc_feature (585)..(585): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctccaacaataagaactacttagcttggtatcaagaaaaaccnggacagcctactaagctgctacattactgggcatcctacccgggatccggggtccctgaccgtattccagtggcaggcggtctgggcacgagtactttaccacgtctacaccgtatcgagcacgccgtgaccgaggtctagaagatggtaggacttagtttacttacgtagtcgaagtactaaagtataaggtaaaacgtttactttacccgttttaacgtttcccggaccccgtttagggtaaaccctaaagggtaggtaacttaacttaccgaaaacgtaacgtggtacgacgttacgacctaaccgngttaccgttcg

SEQ ID NO: 352536 - DNA, 544 bp, Homo sapiens
  misc_feature: GZ8MTXP02GFIC8.15.3.A03.1.454.CMB.2.raw
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataagaactacttagcttggtatcaagaaaaaaccaggacagcctctaagctgctcattacnggcatctacccggaatccggggtcctgaccgattccagtgcagcggtctggcacagtattcactctcaccatcancagcctgcaggctagagatgtggctagtttatactgtacagcaaagtatagaaaagttctttaccgttttactttccgggacccttagggggtaaccctaaaaggttggaaacttacgtaaccaaaacggtaactggtacggcttacggacaaccctattcgtttcg

SEQ ID NO: 352537 - DNA, 629 bp, Homo sapiens
  misc_feature: GZ8MTXP02H4R0U.15.3.A03.1.454.CMB.2.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagacctccctggctgtgtctctgggcgaggagggccaccatcaactgcaagtccagccagagtgtttanacagctccaaanaataagaactacttagcttaggtatcaagaaaaaccaggacagcctacctaagctgctcaatttacgnggacataccgtacccgggaatcccggggtcctgaccgtattccagtgcaggcggtctggcacgagtactttcactctcaccatcagcacgccctgaccagggctaggaaagtgtggtacggacttaagtttttacgttaacttggttaccaggtacctaaagttagttaagggtaaaagtttaccttttaccgtttttaaaccgttttcccgggacccgtttagggggtaaaacccctaaaagggttgggtaaacttaacgtaaccgtaaaacgtaccgttaaggtcggtacttacggacctacccgtattactttccg

SEQ ID NO: 352538 - DNA, 607 bp, Homo sapiens
  misc_feature: GZ8MTXP02IDNAL.15.3.A03.1.454.CMB.2.raw
  modified_base (231)..(231): a, c, t, g, unknown or other
  misc_feature (231)..(231): n is a, c, g, or t
  modified_base (315)..(315): a, c, t, g, unknown or other
  misc_feature (315)..(315): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagacctccctggctgtgtctctgggcgaggagggccaccatcaactgcaagtccagccagagttgtttanacagcctaccaaacaataaagaactacttagcttggtatacaagaaaaaaccaggacacgcctacctaagctgctctatttacngggacatccgtacccgggaatcccggggtccctgaccgattccgagtggcagcggtctggcacagtactttcactctcaccatcagcagcctgacaggctaggaagtgtaggtcggtacttaaaggttttattaccgtaggtcaagtactaaattattagggtaaaactttctttaccctttttacgttacccggtaccgttacggggtaaaccctaaaagggtggaaacctttagtaaccgtaaaacgtaacgtggttaacgggcttacggaccaaccgtattacctttcg

SEQ ID NO: 352539 - DNA, 597 bp, Homo sapiens
  misc_feature: GZ8MTXP02GIKL7.15.3.A03.1.454.CMB.2.raw
  modified_base (231)..(231): a, c, t, g, unknown or other
  misc_feature (231)..(231): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgttttanacagctaccaacaataagaactacttagcttggatacaagaaaaaccagacagcctacaagctgctctatttacgtggactagtaccgtaacccggggaacgtcccggggtcccctaggaccgtacttaccccgaggtcggacgaggtcggggtctcgggccacgagtactttccaccttctaccacccatcaacgcacgcctgacgacggctagaagtagtgtcggtacttaagtttatacgtgtacaagacgtaaatagttagtaaacttcttttacccgtttacgttcccggaccgttaggaaaccgtaaagtggaaactacgtaaccaaacgttacgtgtacgctacgactacctagtctcg

SEQ ID NO: 352540 - DNA, 551 bp, Homo sapiens
  misc_feature: GZ8MTXP02FQ1EN.15.3.A03.1.454.CMB.2.raw
  modified_base (228)..(228): a, c, t, g, unknown or other
  misc_feature (228)..(228): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctccaacaataagaactacttagcttggtatcaagaaaaaccaggacagcctacaagctgctcatttactggcatccgtaccgggaagtccggggtccctgaccgattcccgagtgcaggcggtctggcacagtattcactctacaccatcagcagcctgcagctagaagatgtgactagtttactatgtacagactaaatatagtaaaagttctttaccgtttttaacgtccggtacccgttacggggaaacctaaaagggtcgtaattactaacgaaaaccgttaagtgtacggactacggacaacctattacttcg

SEQ ID NO: 352541 - DNA, 578 bp, Homo sapiens
  misc_feature: GZ8MTXP02JFMVR.15.3.A03.1.454.CMB.2.raw
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (405)..(405): a, c, t, g, unknown or other
  misc_feature (405)..(405): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaacaataagaactacttagctgtatcaagaaaaaccnggacagcctactaagctgctcattacnggcatccgtacccggatcccggggtcctgaccgattccgagtcgcaggcggtctgggcacagtactttcactctacacatcagcagcctgcaggctagaagngtgtggactaggttttaatacgtgtaccaagactaatagtagtaaaagtttctttacccgtttttaacgttcccggtacccgttaggggaaacccttaaaaggtcggttaaacttacgtaaccgaaaaccgttacgtaaggttcggacttcggaaccacgttactcgtttacg

SEQ ID NO: 352542 - DNA, 589 bp, Homo sapiens
  misc_feature: GZ8MTXP02GMZLI.15.3.A03.1.454.CMB.2.raw
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgttttatacagctaccaaacaataaagaactactagcttgtatacaagaaaaaccaggaacacgacctactaagctagctactatttactgggactagtacccgtaaccccgggaacgttccccggggtccctagaacccgtattcccgaaggtcggacgacggtcgggtctgggccacgtaagtactttccactctaccacctatcacgcacgccctgacgacggctagaagagtgtggacttaagtttactactgtacagataatatagtaaaattctttaccttttacgtccggtaccgtacgggaactaaagtgtaatactaacgaaacgtatgttacgctacgctaactacttcgttac

SEQ ID NO: 352543 - DNA, 549 bp, Homo sapiens
  misc_feature: GZ8MTXP02GQ22T.15.3.A03.1.454.CMB.2.raw
  modified_base (230)..(230): a, c, t, g, unknown or other
  misc_feature (230)..(230): n is a, c, g, or t
  modified_base (310)..(310): a, c, t, g, unknown or other
  misc_feature (310)..(310): n is a, c, g, or t
  modified_base (423)..(423): a, c, t, g, unknown or other
  misc_feature (423)..(423): n is a, c, g, or t
  modified_base (447)..(447): a, c, t, g, unknown or other
  misc_feature (447)..(447): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaataagaactacttagcttggtatcaagaaaaaaccaggacagcctacctaagctagctcatttacngggacatcgtacccgggaatcccggggcctgaccgattcccgagtggcaggcgggtctcgggcacagtactttcacctctccaccaatcagcagccctgcacggctagaaagntgagctagtttattacgtgtacanacaaattagtagtaaattactttaccgtttacgttcggtaccgtagggaactaaaggtgtactacgtaacaaacgtactggtcgactacgacctactatctg

SEQ ID NO: 352544 - DNA, 573 bp, Homo sapiens
  misc_feature: GZ8MTXP02H07N9.15.3.A03.1.454.CMB.2.raw
  modified_base (229)..(229): a, c, t, g, unknown or other
  misc_feature (229)..(229): n is a, c, g, or t
  modified_base (308)..(308): a, c, t, g, unknown or other
  misc_feature (308)..(308): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtggcgaggaggccaccatcaactgcaagtccagccagagttgtttanacagctaccaaacaataagaactactagcttggtatacaagaaaaaaccaggacacgcctacctaagctgctcattacnggcactcgtaccgggaagtccgggtcctggaccgattccgagtcggcaggcgggtcgtggcacgagtactttcactctacacatacagcacgacctgcaggctaggaagtgtagcgtacttagttttatacgtgtacgagataaatagtagtaaacgttacttttccttttaacgttcccggtaccgtacgggtaaacctaaaggttacggtaattaacgtacgtaaaacgtacgttggacgtcgtacgtacacctattcttacg

SEQ ID NO: 352545 - DNA, 531 bp, Homo sapiens
  misc_feature: GZ8MTXP02FTD0A.15.3.A03.1.454.CMB.2.raw
  modified_base (230)..(230): a, c, t, g, unknown or other
  misc_feature (230)..(230): n is a, c, g, or t
  modified_base (279)..(279): a, c, t, g, unknown or other
  misc_feature (279)..(279): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagttgttttanacagctaccaaacaataagaactacttagcttggatcaagaaaaaaccnggacagcctacctaagctagctacatttaccgtggcatctacccgggaatcccggggtacctgaccgattccagtggcagcggtctgggcacagtattcactctcaccatcagcagtcngcngnagantgtgtatagttatacgtntanananatatagtaattacttactttacgttcgtaccgtacggtaacgtaacgtagtactactaactaacgtaacgtaagtacgtacgtacgacactactactcg

SEQ ID NO: 352546 - DNA, 591 bp, Homo sapiens
  misc_feature: GZ8MTXP02HVJZ1.15.3.A03.1.454.CMB.2.raw
  modified_base (230)..(230): a, c, t, g, unknown or other
  misc_feature (230)..(230): n is a, c, g, or t
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (417)..(417): a, c, t, g, unknown or other
  misc_feature (417)..(417): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaataagaactactagcttaggtatacaagaaaaaccnggacagcctactaagctgctctatttacgnggcatcgtacccgggaatcccggggtcctgaccgattccgagtgcaggtcggtcnggcanagtacttccactctcaccatcagcacgccctgcgaggctagaaagtntggtgtacttagttttattacgtgtacaagtacaaatagtaagtaaaagtttactttacccgtttttacgttccgggacccgttaggggtaaaccctaaaaggttcggtaaataacgtaaccgaaaacggtacgttggtacggtacctacggacctaaccgtatttccgtttcg

SEQ ID NO: 352547 - DNA, 575 bp, Homo sapiens
  misc_feature: GZ8MTXP02IWVHT.15.3.A03.1.454.CMB.2.raw
  modified_base (405)..(405): a, c, t, g, unknown or other
  misc_feature (405)..(405): n is a, c, g, or t
tcagtctacgtagccacgaccggtgctcgatttagagagcgtcacaggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaaacaataagaactacttagcttggtatcaagaaaaaccaggacagcctacctaagctagctcatttactggcatccgtaccggaatcccggggtcctgaccgattccagtgcagcggtctggcacagtattccactctcaccatcagcacgcctgcacggctagaaagngtggtagtacttaagtttacttacgtgtacagtactaaatatagtaaaacgtttcttttaccgttttacgttcccggtacccgttagggtaaaccgtaaaggttggtaaacttaacgtaaccgaaacggtaactaaggtacggtactacgacctaaccgtcttacgttcg

SEQ ID NO: 352548 - DNA, 536 bp, Homo sapiens
  misc_feature: GZ8MTXP02FNDHG.15.3.A03.1.454.CMB.2.raw
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
  modified_base (444)..(444): a, c, t, g, unknown or other
  misc_feature (444)..(444): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataaagaactacttagcttggtatcaagaaaaaaccaggaacagcctcctaagctgctcatttacnggcatctacccgggaatccggggtcctgaccgattccagtgcagcggtcnggcacagtattcactctcaccatcagcagcctgcaggctgaagatggtggctaagtttattaactgtacagcaaatatagtaaaagtntttacccttttaactttccgggacccttaggggaaccctaaaaggtggaaatagtacaaaacgtaaactgtacggactcgacaaccattctg

SEQ ID NO: 352549 - DNA, 582 bp, Homo sapiens
  misc_feature: GZ8MTXP02JB91R.15.3.A03.1.454.CMB.2.raw
  modified_base (309)..(309): a, c, t, g, unknown or other
  misc_feature (309)..(309): n is a, c, g, or t
  modified_base (432)..(432): a, c, t, g, unknown or other
  misc_feature (432)..(432): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaaacaataagaactacttagcttggtatacaagaaaaaccaggacagcctacctaagctgctcatttacnggcatccgtaccggaatcccggggtccctgaccgattccagtggcagcgggtctgacacagtactttcactctacaccatcagcagcctgcaggctagaagatggtgacgtagtttacttacngtacagacaatatagtaaagttactttaccttttaacgttccggtacccgttaggggaaaccctaaaaggttcggtaaacttaacgtaccgtaaaacggtaaccgttaaggtacggtacttacggacctaacccgtagttacctttacgg

SEQ ID NO: 352550 - DNA, 574 bp, Homo sapiens
  misc_feature: GZ8MTXP02FIPWY.15.3.A03.1.454.CMB.2.raw
  modified_base (230)..(230): a, c, t, g, unknown or other
  misc_feature (230)..(230): n is a, c, g, or t
  modified_base (313)..(313): a, c, t, g, unknown or other
  misc_feature (313)..(313): n is a, c, g, or t
  modified_base (391)..(391): a, c, t, g, unknown or other
  misc_feature (391)..(391): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagcctaccaaacaataagaactacttagcttggtatacaagaaaaaaccaggacacgcctacctaagctgctcatttacgnggcatccgtacccgggaagtcccgggtccctgaccgtattccgagtggcaggcggtctgggcacgagtacttcactcncaccatcagcagcctgcagctagagagtgagctagtttatacgtgtacagctaaattagtagtaaaacgtttctttaccgtttttacgttcccggaccgtaggggtaacctaaaaggtcggtaacttaacgtaaccgaaaacgtaacgtggtacggtactacgacctaacctagttcgttacg

SEQ ID NO: 352551 - DNA, 608 bp, Homo sapiens
  misc_feature: GZ8MTXP02JL9UU.15.3.A03.1.454.CMB.2.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (309)..(309): a, c, t, g, unknown or other
  misc_feature (309)..(309): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaanaataagaactacttagcttggtatacaagaaaaaaccaggaacagcctacctaagctgctacatttacnggcatccgtacccggaagtcccgggtccctagaccgattccagtgcagcggtctggcacagtactttacactctcaccatcaagcacgcctgacgacggactggaaagtatggtaggtacttaggtttaattacgttgtacgtagactaaataagttaagtaaaacgtttactttacccgttttaacgttacccgggtaccccgtaggggtaaaccctaaaacggtaggttaactaacgtaaccgtaaaaccgtacgtaaggttacgacgttacggacctacgtaaccgtttacgtacg

SEQ ID NO: 352552 - DNA, 576 bp, Homo sapiens
  misc_feature: GZ8MTXP02FUT48.15.3.A03.1.454.CMB.2.raw
  modified_base (229)..(229): a, c, t, g, unknown or other
  misc_feature (229)..(229): n is a, c, g, or t
  modified_base (319)..(319): a, c, t, g, unknown or other
  misc_feature (319)..(319): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctaccaacaataacgtaactacttagcttaggtatacaaacgaaaaaccaggaacacgacctacctaagtctgctactatttacgnggactatccgtaacccgggacgtcccgggtccagacctatccgagtcgacgaggcggtcgtagggactagtacttccactctacactatcacgcagcctgcgaggctagaagngtggngtacttaagtttattacgtgtacagactaagttattaatacgtaccgtccggtagggtaccggtccggacgtaaacgggacctaagggtagaaactaccgaaaacgacgtaggtcgactacgacactacgtctacgtac

SEQ ID NO: 352553 - DNA, 562 bp, Homo sapiens
  misc_feature: GZ8MTXP02GBTL7.15.3.A03.1.454.CMB.2.raw
  modified_base (445)..(445): a, c, t, g, unknown or other
  misc_feature (445)..(445): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataaagaactactagcttggtatcaagaaaaaaccaggacagcctacctaagctgctcatttactgggcatcctacccgggaatcccggggtccctgaccgattccagtggcaggcggtctgggcacagtattcatctcacatcagcagcctgcaggctagaagtatgtgggactaggtttacttaacgtgtacagcaaattanagtaaaacgtttttaccccttttaacgtttccggacccgttaggggaaaccctaaaaggttaggaattaacgtaaaccaaaacgtaacgtggttacggcttcgactaccattcttcg

SEQ ID NO: 352554 - DNA, 596 bp, Homo sapiens
  misc_feature: GZ8MTXP02FZO8E.15.3.A03.1.454.CMB.2.raw
  modified_base (230)..(230): a, c, t, g, unknown or other
  misc_feature (230)..(230): n is a, c, g, or t
  modified_base (313)..(313): a, c, t, g, unknown or other
  misc_feature (313)..(313): n is a, c, g, or t
  modified_base (340)..(340): a, c, t, g, unknown or other
  misc_feature (340)..(340): n is a, c, g, or t
  modified_base (414)..(414): a, c, t, g, unknown or other
  misc_feature (414)..(414): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaataagaactacttagcttggtaatacaagaaaaaaccaggaacagcctacctaagctgctcatttacgnggcatctacccgggatcccggggtccngaccgattccgagtggcaggcggtctgggcacagtatttcactctcaccatcagcagcctgcaggctgaaagtntggtcggacttaagtttattacctgttacaagtaccaaattagtaagttaaaagtttctttaccgttttaacgtttccggtaccccgttagggggaaacccttaaaaggtgggtaaacttaacgtaaaccgtaaaaccgtaaacgttgtacgggcttacgaccaacccgtattacctttacg

SEQ ID NO: 352555 - DNA, 583 bp, Homo sapiens
  misc_feature: GZ8MTXP02JZ0RU.15.3.A03.1.454.CMB.2.raw
  modified_base (230)..(230): a, c, t, g, unknown or other
  misc_feature (230)..(230): n is a, c, g, or t
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacaataagaactacttagcttggtatcaagaaaaaccaggacagcctactaagctgctcatttacnggcatcacccggaatccgggtcctgaccgattccgagtgcagcggtctgcacagtattcactctcaccntcagcagctgcaggctagagatgtggctagtttatactgtacagctaatatagtaaaacgttctttaccgttttaaacgtttccgggaccccttaagggggtaaaccctaaaaagggttcggtaaactttaaaacgtaaccgtaaaaaaccggttaaacgtggttacgggaaccttcggaacccgtaaccctaaggtttcctttaacgg

SEQ ID NO: 352556 - DNA, 563 bp, Homo sapiens
  misc_feature: GZ8MTXP02GFRB9.15.3.A03.1.454.CMB.2.raw
  modified_base (308)..(308): a, c, t, g, unknown or other
  misc_feature (308)..(308): n is a, c, g, or t
  modified_base (449)..(449): a, c, t, g, unknown or other
  misc_feature (449)..(449): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaaacaataagaactacttagcttggtatcaagaaaaaccaggacagcctacctaagctgctcatttacngggcatctacccgggaatcccggggtcctgaccgtatccagtgcagcggtctgggcacagctttcactctcacatcagcagcctgacaggctagaagatgtaggctaggtttattactgtcagacaatataggaaaatttnttacccttttacgttccggtaccgttacggggtaaccctaaaggttacggaattacgtaaccgaaaacgtacctaaggttacggacttacggacctaacctacgttctttaccg

SEQ ID NO: 352557 - DNA, 769 bp, Homo sapiens
  misc_feature: GZ8MTXP02GPIUN.15.3.A03.1.454.CMB.2.raw
  modified_base (315)..(315): a, c, t, g, unknown or other
  misc_feature (315)..(315): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccaagagttgttttatacagctaccaaacaataaagaactacttagcttggtatacaagaaaaaccaggaacacgcctactaagctgctctaatttacgngggtcaacgtccgtaacccggggaacgtcccgggggtaccctacggtaccgtattcccgaagtcgggacacggggtcgggttcgttacgggaccacgtaacggtaacttttaccaaccttccctacaaccctaaatacccgaaacggccctaacggcccccgttgtaacccgacgggtacgtaaggtaaagtacgttgggttacggttacgtttaaaggtttttaacgttacgttacgttaccgtaaagtaacgtaaaagttaagttaaacgtttaaaaacgtttaaccgtttttaaccccgttttttaaccgtttacccccgggtaccccggtttaaacggggtaaaacccgttaaaagggtaacggttaaacttaaaacgttaaaacccgtaaaacggttaacggtaagggttacggtaccttacggtacctaaccgtaacgtttcgttacg

SEQ ID NO: 352558 - DNA, 547 bp, Homo sapiens
  misc_feature: GZ8MTXP02F98YL.15.3.A03.1.454.CMB.2.raw
  modified_base (312)..(312): a, c, t, g, unknown or other
  misc_feature (312)..(312): n is a, c, g, or t
  modified_base (383)..(383): a, c, t, g, unknown or other
  misc_feature (383)..(383): n is a, c, g, or t
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaaacaataagaactactagcttggtatacaagaaaaaaccaggacagcctacctaagctgctactatttacgngggacactaccgtacccggggaagtcccggggtccctgaccgtatccaggtgtcgagtcgggtctggcacngtattcactctcaccatcagcacgcctgcaggctagacgangtggctagtttatctgtanagactaatataagtaaagttctttaccttttacgttccggaccgttagggacctaaagtcggaatactacctaaaacggatggtgacgtcgactacacttctcg

SEQ ID NO: 352559 - DNA, 599 bp, Homo sapiens
  misc_feature: GZ8MTXP02IUAHU.15.3.A03.1.454.CMB.2.raw
  modified_base (229)..(229): a, c, t, g, unknown or other
  misc_feature (229)..(229): n is a, c, g, or t
  modified_base (310)..(310): a, c, t, g, unknown or other
  misc_feature (310)..(310): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctacaacaataagaactacttagcttaggtatacaagaaaaaccaggacagacctacctaagctgctctatttacgnggcagtccgtacccgggtaagtcccggggtcctagaccgtattccgagtcggacaggtcgggtctggcacagtacttcactctcaccatcagcacgcctgacgaggactagaaagtgtgtaggtaccttaggttttaactttacgtcggttacaaggtacctaaagttagtaacggtaaaagtttacctttaccgtttttaacgttacccggtacccgtaggggtaaacctaaaggtggtaattacgaactaaacgtatgtaggactacgacctacgtacttcgttacg

SEQ ID NO: 352560 - DNA, 593 bp, Homo sapiens
  misc_feature: GZ8MTXP02FTZY1.15.3.A03.1.454.CMB.2.raw
  modified_base (230)..(230): a, c, t, g, unknown or other
  misc_feature (230)..(230): n is a, c, g, or t
  modified_base (281)..(281): a, c, t, g, unknown or other
  misc_feature (281)..(281): n is a, c, g, or t
  modified_base (342)..(342): a, c, t, g, unknown or other
  misc_feature (342)..(342): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaataagaactacttagcttgtatacaagaaaaaacccnggaacagacctactaagctgctacatttactggcatcgtacccgggaagtcccggggtccngaccatccagtgcagcggtctaggcagagtattccacttctacacctatcagcagtcctgcaggctagaagatggtagtactagtttatacgtgtacganactaaagttataaggttaaaacttnttttaacccgtttttaacgttcccggtaccccgttaggggtaaaccctaaaaggtcggtaaattaactaaacgaaaacccgttaagttcgggtggtacctacggacctaacctataccctttacgg

SEQ ID NO: 352561 - DNA, 644 bp, Homo sapiens
  misc_feature: GZ8MTXP02HR3E9.15.3.A03.1.454.CMB.2.raw
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagagttgtttanacagctaccaaataataagaactacttagcttaggtatacaaagaaaaaaccnggaacacgcctacctaagctgctactatttacgnggactacgtccgtaccccgggaagtccccggggtccctaggaccgtattcccgaggtcggcgacgggtcgggtactgggccacgtagttactttccaccttccactacccatacacgtccacgcccgtagaccgaggtacgtaggaaagtagtgggtacgtacttaaggttttacttaacgtcgtacaagtactaagttaagtagtaaaacgtttctttaccgttttacgttccggtacccgttagggtaaacctaaaggtcggtaaacttacgaacgtaaaacggtattaacggtcgacgtacgacctaacctcgtttcttcg

SEQ ID NO: 352562 - DNA, 642 bp, Homo sapiens
  misc_feature: GZ8MTXP02HZJMD.15.3.A03.1.454.CMB.2.raw
  modified_base (226)..(226): a, c, t, g, unknown or other
  misc_feature (226)..(226): n is a, c, g, or t
  modified_base (228)..(229): a, c, t, g, unknown or other
  misc_feature (228)..(229): n is a, c, g, or t
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (300)..(300): a, c, t, g, unknown or other
  misc_feature (300)..(300): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctggcgagaggccaccatcaactgcaagtccagccagagtgtttanannctacaanaataagaactactgctagtanacaaagaaaacagacacacctactaagctcgctactattacgnggactactaccgtaacccgggtaacgtcccggggtacctacggaccgtattaccgaggtcggacgacggtcgggtacgcggccaacgtagttactttaccaccttctaccaacctaacgtcaacgccgacgccctcgacgacgacgtagaagtagtaggtaggtacgttagtttacgtttacgttagtacgtacgtagtaaataagttaagtaaagtttaacgttttaccgttttaccgtttaccggttacccgttacgggtaaaccggtaaacggtaacggtaacgtaacgtaacgtaaacgtaaacgtaacgtacgtacgtacgtactacctactactcg

SEQ ID NO: 352563 - DNA, 595 bp, Homo sapiens
  misc_feature: GZ8MTXP02FV2ZA.15.3.A03.1.454.CMB.2.raw
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaacaataagaactatagcttggtatcaagaaaaaccagacagcctacctaagctgctcatttacnggcatccgtacccgggaactcccggggtcctgaccgtattccgagtggcgaggcgggtctgggcacagtactttcactctcacctatcagcacgcctgcgaggctagaagtagtgtaggacttagtttacttacgtgtacaagtacaaagttagtagtaaaacgtttactttaccgttttacgtttacccggtacccgttagggtaaaccctaaaggttaggtaacttaacgttaacgaaacgtaaccgttaaggtacggtactacggtacctaacctacgttctttacg

SEQ ID NO: 352564 - DNA, 655 bp, Homo sapiens
  misc_feature: GZ8MTXP02JT91V.15.3.A03.1.454.CMB.2.raw
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (319)..(319): a, c, t, g, unknown or other
  misc_feature (319)..(319): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagtagttagtttanacagcctaccaaanaataagaactacttagtctaggtatacaagaaaaaccaggacacgcctaccaagctgctactatttacgnggctacgtccgtaacccgggtacgtcccggggtccctacgaccgtacttccgaggtcggacgacgggtcgggtcgtcgggccacgtagtactttacaccgttcctaccacctatccaacgtccacgtcccgtgacgacggtcgtaagaagtacgttggtagggtactttaaggtttactaccgtgtacaagtactaaattagtaacgttaaactttaccgttttccgttttaaacgttcccggtaccggttacgggaaactaaacgggttagaaacttaacgtaaccgtaaaacgttaacgtggtaccggtacttacgacctaccttatcgtttac

SEQ ID NO: 352565 - DNA, 584 bp, Homo sapiens
  misc_feature: GZ8MTXP02HSEZW.15.3.A03.1.454.CMB.2.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
  modified_base (377)..(377): a, c, t, g, unknown or other
  misc_feature (377)..(377): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctccaacaataagaactacttagcttagtatacaagaaaaaccaggacagcctactaagctgctctatttacnggcatcgtacccgggaatcccggggtcctggaccgtattcccgagtcggcaggcgggtctgggcacagtntttcactctcacccatcagcacgcctgcagggctagaaagtgtggtaggtcttaagttttacttacgtgtaccagtacaattagtagtaaacgtttctttccgttttaacgttcggtacccgttaggggaaacctaaaggtggtaactacgtacgtaaaacgacgttggtacggtacttacggacctaacccgttctttaccgttcg

SEQ ID NO: 352566 - DNA, 671 bp, Homo sapiens
  misc_feature: GZ8MTXP02G3HOT.15.3.A03.1.454.CMB.2.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (320)..(320): a, c, t, g, unknown or other
  misc_feature (320)..(320): n is a, c, g, or t
  modified_base (539)..(539): a, c, t, g, unknown or other
  misc_feature (539)..(539): n is a, c, g, or t
  modified_base (648)..(648): a, c, t, g, unknown or other
  misc_feature (648)..(648): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgccgtacggggacatcgtgatgacccagtctccagacctcctggctgtgtctcgtggcgagacggccaccatcaactgacaagtccagcagtagttgtttanacagctaccaaanaataaagaactactagcttaggactacaaacgaaaaaccnggaacacgacctactaagctagctactaatttacgnggactaacgtacccggtaaacccgggaacgttccccggggtaccctaggtacccgtattaccgaggtcggacgtacgggtcgggtcacgggcctaacgtagttactttaccaccttcctaccaaccactacgaaacgccaacgtcccgtacgaccgacggtacgtaaggaaaacgtagttcggtaacgggttacctttaaaagggttttacctttacgngttaaccggaataacctaaaagttacgttaagtaaaacgttttctttcccgttttaaacgtccggacccgttaaggaaactaaagtcgaataacgtaaccaaagtacgngtacgtcacacaacgtcttcgtc

SEQ ID NO: 352567 - DNA, 621 bp, Homo sapiens
  misc_feature: GZ8MTXP02FPKQN.15.3.A03.1.454.CMB.2.raw
  modified_base (229)..(229): a, c, t, g, unknown or other
  misc_feature (229)..(229): n is a, c, g, or t
  modified_base (326)..(326): a, c, t, g, unknown or other
  misc_feature (326)..(326): n is a, c, g, or t
  modified_base (395)..(395): a, c, t, g, unknown or other
  misc_feature (395)..(395): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttanacagctaccaacaataagaacttacttagcttaggtaatacgaaagaaaaaacccaggaacacgaccctacctaaagcctagcctactaatttacgngggcactacccgtacccgggaacgttcccggggtaccctagaccgtattccgagtcggacaggcggtcngcacagtacttcactctacaccatccagccagcctgccaggtctaggaagagtgtaggacttaagtttacttactcgtaccaagtactaaagtattagtaaagtttacctttaccgtttttaaccgttccgggtaccccgttagggaaacccgtaaaaggtcggtaaataacgttaaccgaaaccgtaaagtggtcggtactacggccctaactacgttactttcg

SEQ ID NO: 352568 - DNA, 566 bp, Homo sapiens
  misc_feature: GZ8MTXP02GD2LV.15.3.A03.1.454.CMB.2.raw
  modified_base (231)..(231): a, c, t, g, unknown or other
  misc_feature (231)..(231): n is a, c, g, or t
  modified_base (320)..(320): a, c, t, g, unknown or other
  misc_feature (320)..(320): n is a, c, g, or t
  modified_base (461)..(461): a, c, t, g, unknown or other
  misc_feature (461)..(461): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttanacagctaccaaactaataagaacttacttagcttaggtatacgaaagaaaaaaccgaggaacagcctactaagctgctactatttacgnggcagtaccgtaaccgggacgtcccggggtcctgaccgtattccaggtcgcaggtcggtctggcacagtactttcacctctacacgatcaagcacgcctgaccaggctagggaatgtggtacggtactaagtttactacgngttacgaatacaaattataggtaaaactttctttacccgtttagttcccgacgttaggaacctaaaggtgatacgtacaacgtatgtcgcgtacacacgtctctc

SEQ ID NO: 352569 - DNA, 627 bp, Homo sapiens
  misc_feature: GZ8MTXP02F6EMA.15.3.A03.1.454.CMB.2.raw
  modified_base (230)..(230): a, c, t, g, unknown or other
  misc_feature (230)..(230): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaataagaactacttagcttggatcaagaaaaaccaggacagcctactaagctgctnattacnggcatcgtacccggaatcccgggtcctgaccgattccagtggcaggcggtactggcacagtatttccacttctccacatacacgcacgccctgaccgaggtctaggaagagtgttacgggacttaaggttttacttacgtcggttaccaagtacctaaatagttaaccggtaaaagtttcttttaccccgtttttaagtttcccggacccgtttaacgggggaaacctaaaacgggttcggtaaattaaacggttaaaccaaaacggtaaaccgttgggtaaggtccccttaggaccctaacctaacgtttacgtttacccg

SEQ ID NO: 352570 - DNA, 611 bp, Homo sapiens
  misc_feature: GZ8MTXP02FS7GL.15.3.A03.1.454.CMB.2.raw
  modified_base (231)..(231): a, c, t, g, unknown or other
  misc_feature (231)..(231): n is a, c, g, or t
  modified_base (316)..(316): a, c, t, g, unknown or other
  misc_feature (316)..(316): n is a, c, g, or t
  modified_base (382)..(382): a, c, t, g, unknown or other
  misc_feature (382)..(382): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctacaaacaataagaactacttagcttggtaatacaagaaaaaaccaggacagccctacctaagctagctactatttacgnggcactaccgtacccgggaagtccccggggtaccctggaccgtattcccgagtcgcaggcgggtcngacacagtacttcacttctacacctatacacgcacgccctgaccgaggtactaggaaagtagtggtaggtacttaagtttacttaccgtgtacgagtactaattaatagtaaaagtttctttacccgttttacttaccgggtacccgtagggaaaccctaaaggttacggactaaacgttaacgaaacgttaactgggttacgacgttacgacctactactcctttacg

SEQ ID NO: 352571 - DNA, 651 bp, Homo sapiens
  misc_feature: GZ8MTXP02FO8FY.15.3.A03.1.454.CMB.2.raw
  modified_base (230)..(230): a, c, t, g, unknown or other
  misc_feature (230)..(230): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccacatcaactgcaagtccagccagtagttgtttanacagctaccaacaataaagaactacttagcttggtaatacaaagaaaaaaccaggaacagccctactaagctgctactatttactgggcactaccgtaacccggggagtcccggggtccctggaccgtatcccgagtcggcgaggtcggtactgggcacgagtacttaccactctacaccctatcacgcacgccctgacgaggtctaggacgtagttcggtaggtaccttaagttttatacgttagacgtaagaccttaaagttacgtaaggttaaaaacgtttcctttttaaccccgtttttaaaccgtttcccgggtaacccgtttacgggggtaaacctaaaagggttggtaaacttaacgtaaacgaaacgttaacggtggttacgaccgtacgacctaacggtactttcgtttacg

SEQ ID NO: 352572 - DNA, 618 bp, Homo sapiens
  misc_feature: GZ8MTXP02HEFO8.15.3.A03.1.454.CMB.2.raw
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaacgtccagccagagttgttttanacacnctacaaacaataacgtaactactagtctagtanacaaacgaaaaccagacacgcctactagctcgctactattacgnggtcacgtaccgtaccgggtacgtcccgggtcctacggaccgtactaccgagtcgacgacggtcggtcgtcggcgacgtacgtacttacactcaccacctatcacgcacgctgacgaggactagaagtagtggtacggtatttaagtttacgttacgtacgtacagaactaattagtaacgttaaactttactttaccgttttacgtacccggtaccgtaagggtaaccgttaaaggtcgtaaacttaacgaaacgtaaacgtacgtaacggtacggtactacggacctaccgtacttacgtac

SEQ ID NO: 352573 - DNA, 593 bp, Homo sapiens
  misc_feature: GZ8MTXP02F3L5C.15.3.A03.1.454.CMB.2.raw
  modified_base (237)..(237): a, c, t, g, unknown or other
  misc_feature (237)..(237): n is a, c, g, or t
  modified_base (292)..(292): a, c, t, g, unknown or other
  misc_feature (292)..(292): n is a, c, g, or t
  modified_base (325)..(325): a, c, t, g, unknown or other
  misc_feature (325)..(325): n is a, c, g, or t
  modified_base (398)..(398): a, c, t, g, unknown or other
  misc_feature (398)..(398): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgccgtacggggacatcgtgatcgacccagtctccagactccctggctgtgtctcgtgggcgaggacgggcccaccatcaactgacaagtccagccagtagttgtttanacagctaccaaacaataaagaactacttagacttaggtaatacaaagaaaaaccnggaacacgcctactaagctgctactatttacgnggctacgtacccgtacccgggtacggtcccgggtcctgacctatccgaggtcggcgacggcggtctcggccanacgtatttccactctaccactactcacgcacgcctgacgtaggctaggtaagatcggtagacttaaggtttactactcggtacaagtactaagtataggttaactttctttaccgtttacgtccggaccgtaggaaactagtacgtaactacttaacaaacgttagtgtaacggctacgaccctatactctttac

SEQ ID NO: 352574 - DNA, 700 bp, Homo sapiens
  misc_feature: GZ8MTXP02IQXSQ.15.3.A03.1.454.CMB.2.raw
  modified_base (237)..(237): a, c, t, g, unknown or other
  misc_feature (237)..(237): n is a, c, g, or t
  modified_base (456)..(456): a, c, t, g, unknown or other
  misc_feature (456)..(456): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgacaacgtccagccagtagttgttttanacagtctaccaaataataaagaacttacttagtcttaggtaatacaaagaaaaaccaggacacgacctaccaagctagctactaatttacgtggactacgtacccgtaacccggggtaacgtccccggggtcctaggaccgtattccgagtcggcgacgggtcggtcgtcgccgtacgtagtactttaccaccttctaccaacctactaccgacgaccncggtaccctggacccgagggtacctaagggaaagtcgttagggtcggtaactttaaggtttaacttacgtcgtaaccgagtaactaaagttagttaacggtaaagtttacctttaccgtttttacggtaccccggtacgtaacgggtaaaccgaaagttacggtaaactttaaccgaaaccgtaaaacggtacgttaacggtcggtaacccttcggaccctaacccggtttacgtttccgtacg

SEQ ID NO: 352575 - DNA, 580 bp, Homo sapiens
  misc_feature: GZ8MTXP02GDHLR.15.3.A03.1.454.CMB.2.raw
  modified_base (228)..(228): a, c, t, g, unknown or other
  misc_feature (228)..(228): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttanacagctccaacaataagaactacttagcttggtatacaagaaaaaaccaggacagcctacctaagctgctcatttacgtggcatcctaacccgggaatccggggtccctgaccgattccagtgcaggcggtctgggcacagtacttcactctcaccatccagcagccctgcaggctagaagtatgtggactagtttatacgtgtacagactaatatagtaaaagttctttaccttttaacgttcggtacccctaggggtaaaccctaaaggttaggaaactttacgttaaaccgaaaacggtaacgttcggtacgggtaccttacggaccctaacctaagtttactttcccg

SEQ ID NO: 352576 - DNA, 590 bp, Homo sapiens
  misc_feature: GZ8MTXP02HGW2F.15.3.A03.1.454.CMB.2.raw
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (418)..(418): a, c, t, g, unknown or other
  misc_feature (418)..(418): n is a, c, g, or t
  modified_base (554)..(554): a, c, t, g, unknown or other
  misc_feature (554)..(554): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccagagttgttttaacagctaccaaacaaataagaactacttagcttaggtatacaagaaaaaccnggacagcctacaagctgctntatttacnggtcactcgtacccgggatcccggggtcctgaccgtatccgagtgcaggcggtctggcacagtacttcactctaccacatcgagcacgcctgcaggctagaagtntggtacggtacttaagtttatacgtgtaccgagactaatagtagtaaaacgttctttaccttttacgtccggtacctagggtaccaaaagtcgaaattacgtaacaaaacgtcgtaaggtcgcgttacactacctntactcccccccccccccccccccccccccccccccg

SEQ ID NO: 352577 - DNA, 659 bp, Homo sapiens
  misc_feature: GZ8MTXP02JE9M5.15.3.A03.1.454.CMB.2.raw
  modified_base (229)..(229): a, c, t, g, unknown or other
  misc_feature (229)..(229): n is a, c, g, or t
  modified_base (276)..(276): a, c, t, g, unknown or other
  misc_feature (276)..(276): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctaccaacaataagaactacttagcttggtatcaagaaaaacngacagcctacctaagctgcctactatttactgggacacgttacccgtaaccccggggaagtccccggggtacccctacggtaaccgtacgttccccgaagttcgggaccacgggtccggggtcttgggccaactaggtactttaccaccttctaccacccgatccaagccagtcctgaccagggctagaagtagtggtagggtccttaagtttacttaacgtggtaacagtaacgtaatataagttaaacgttacttttccgtttttaaaccgttcccggtacccggtacggtaaaccgtaaaaggttcggaattaaccgtaaacgtaaaacggtaaccgtaaggtacgtaccgttacggacctaccgttaacttctttaccg

SEQ ID NO: 352578 - DNA, 740 bp, Homo sapiens
  misc_feature: GZ8MTXP02JQLZN.15.3.A03.1.454.CMB.2.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagacggccaccatcaactgacaagtccagccagagttgtttanacagctaccaanaataagaactactagcttggtatacaagaaaaaccagacagcctactaagctgctanactttacgnggacactacccgtaccgggtaacgttcccggggtaccctaggaccgtagttccgaggtcgacgtaggccgggtactacgtaccaccgtaggttaactttacccacttaccaccctaaaccctagttaccgaaacggtccaaacccgggtacccgttcgggaaccgaacgggggtacccttaagggtaaaaggtacggttcgggttaacgggtaacccggtttaaagtttttaccgttaaccgttacgggtttaacccaagggtaaaccttaaaagttacgtaaaaggttaaaacggttttccttttacccggtttttaaccgtacccgggttaccccgttaagggaaacccttaaaaggtcggtaaaactaacgttacccgaaaaacgtcgttaacggtacggtacttacgacaccgttaactcgttaccg

SEQ ID NO: 352579 - DNA, 636 bp, Homo sapiens
  misc_feature: GZ8MTXP02FW6YS.15.3.A03.1.454.CMB.2.raw
  modified_base (229)..(229): a, c, t, g, unknown or other
  misc_feature (229)..(229): n is a, c, g, or t
tcagtctacgtagcccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcagtcagccagagttgtttanacagctaccaaacaataagaactactagcttaggtatacgaaagtaaaaaccaggaacacgaccctacctaacgctgtcctactacgtttaccgtagggacctagtacccgtaacccggggtaacgttccccggggtaccctagaacccgtattcccgaggtcgacacggtcgggtctaggaccaacgtagttactttacccaacttcacctacccatccaagcaacgcccgtgaccgaggctaggaagacgtggtaggtacttagtttactacgtgtacagtactaaagttacgtagtaaaacggtttctttaccgttttacgtccggtacccgttagggacctaaagtcgtaattaaccgaactaaaccgtagtcggtagtccacgactaaccgtcttcggttac

SEQ ID NO: 352580 - DNA, 589 bp, Homo sapiens
  misc_feature: GZ8MTXP02HCK64.15.3.A03.1.454.CMB.2.raw
  modified_base (231)..(231): a, c, t, g, unknown or other
  misc_feature (231)..(231): n is a, c, g, or t
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttanacagctaccaacaataagaactactagcttaggtatacaaacgaaaaacnggacacgcctactaagctgctactattacgngggcacgtccgtacccgggaatcccggggtacctggaccgtattcccgagtgcaggcggtctcgggcacgagtctttacacttcacacccatcagcagccctgacctaggctagaaatgtgtaggcttaagtttatacgtgtacagtacaaagttataaggtaactttactttacccgttttaacgttcccggtacccgtaggggtaaacctaaaaggttcggaaacttaacgaaccgtaaacgtactggtacgtaccgtcactactacgttcgtcg

SEQ ID NO: 352581 - DNA, 637 bp, Homo sapiens
  misc_feature: GZ8MTXP02GHYH9.15.3.A03.1.454.CMB.2.raw
  modified_base (232)..(232): a, c, t, g, unknown or other
  misc_feature (232)..(232): n is a, c, g, or t
  modified_base (498)..(498): a, c, t, g, unknown or other
  misc_feature (498)..(498): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgttttanacagctaccaaacaataagaactacttagcttggtatacaagaaaaaccaggacagcctactaagctgctctatttacgtggacactacccgtacccggggtaacgttccccggggtacccctaggacccgtatttcccgacggtggaccgagggtcggggtcctgggccacgtagtactttcacctctcaccatcaagtcacgtccgtgaccgagggtctaaggaagtagtggtacggtacttaagtttactaccgtgtacgaanactaaattacgtaagtaaaacgtttccttttaccgtttaacgttcccggaccgttacggggaaaccttaaagggtacgaacttaaacaaccgtaaaacgtacgtcggtagacttcggaacctaccggtattcctttacg

SEQ ID NO: 352582 - DNA, 605 bp, Homo sapiens
  misc_feature: GZ8MTXP02F90XH.15.3.A03.1.454.CMB.2.raw
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (419)..(419): a, c, t, g, unknown or other
  misc_feature (419)..(419): n is a, c, g, or t
  modified_base (445)..(445): a, c, t, g, unknown or other
  misc_feature (445)..(445): n is a, c, g, or t
  modified_base (570)..(570): a, c, t, g, unknown or other
  misc_feature (570)..(570): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagngttgttttanacagctaccaaacaataagaactacttagcttggatacaagaaaaaaccaggaacagccctactaagctgctctatttactgggcatcgtacccgggtatcccggggtccctagacccgattccagtgcagcggtctggcacgagtacttcactctcaccctatcagcagctgacacgtctagaaagngtgtaggctaaaggtttattaccgtnttacgaagacgtaaattagtagttaaaagttctttaaccccgtttttaacgtttcccgggtacccgttacggggtaaaaccctaaaggttcgggtaaattaccgttaaccaaaaccggttaacgngttacggactaccggactaaccgtatacgtttccg

SEQ ID NO: 352583 - DNA, 655 bp, Homo sapiens
  misc_feature: GZ8MTXP02ITQN2.15.3.A03.1.454.CMB.2.raw
  modified_base (260)..(260): a, c, t, g, unknown or other
  misc_feature (260)..(260): n is a, c, g, or t
  modified_base (354)..(354): a, c, t, g, unknown or other
  misc_feature (354)..(354): n is a, c, g, or t
  modified_base (516)..(516): a, c, t, g, unknown or other
  misc_feature (516)..(516): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgccgtacggggacatcgtgatcgacccagtcctccagacctccctggctgtgtctcgtgggcgagacgggccaccataccaactgacaacgtccagccaagtagttagttttaacacagtacctaccaaanaaataaacgaaacttacttagtcgttaggtaactaacgaaaacgaaaaaacccgaggaaccacgtaccctaccgtaagctgctactagttacgnggactagtacccgtacccgggtacgtccccggggtacctacgaccgtacttccgacggtggtacgacgggtcggtcgtggcacgtagttacttccactccacacctatacagccacgcctgcgacggctaggaaatgcgttaggtacttagtttaccttagngtacacgtataagtaagttaacgtaaaacttttctttacccgtttacgtacccggtaccgtaacgggtaaaccgtaagtacgtattaaaccggtaaacctaagtaccgttgcgtacgtacgtaccaccttatccgttac

SEQ ID NO: 352584 - DNA, 699 bp, Homo sapiens
  misc_feature: GZ8MTXP02GFL0M.15.3.A03.1.454.CMB.2.raw
  modified_base (233)..(233): a, c, t, g, unknown or other
  misc_feature (233)..(233): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagttgttttanacagcctacaaacaaataaacgaactacttagacgttggtaatacaaacgaaaaaaccaggaacacgacctacaagctgctactattacgtggactacgtaccgtaacccgggaacgtccccggggtccctggaaccgtacttaccgaggtcggacgtacgggcggggtctacgggccacgtaagtaactttccaaccttcctacaccgtaatacacggaccaacggccttagacccaagggtccgttaaggaaacgtaggtggtttaaccggggtactttaaaggttttaactttaaccgtgggttaaccaaaggtaaccttaaagttaagttaaggtttaaaaactttcgttttaacccgttttacgttacccgggtacccgttaaaggggaaaccttaaaaggttcggaaattactaaacgaaacgtacgtgtcggtactacgacctaacgtcttactttccg

SEQ ID NO: 352585 - DNA, 851 bp, Homo sapiens
  misc_feature: GZ8MTXP02GACJS.15.3.A03.1.454.CMB.2.raw
  modified_base (376)..(376): a, c, t, g, unknown or other
  misc_feature (376)..(376): n is a, c, g, or t
tcagtctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggcttgtgtctcgtgggcgagacgggccaccatcaactgcaacgtcagccagtagttgtttatacagtctacaaacaataaacgaacttacgttaagcttaggaactacaacgaaaaaccaggtacacgacctactaagctagcctatactttacgacggactaacgtacccgtacccggggtaaagttcccccgggtaccgttanaacccgggtacttaccccggtaaaggttccggtacaaacgggggttacccggttccgacggggtaccaaacccgttaagggtaaccgttttttaccccgacccgtttaaccgtacctaaaaccccctagttacccgaacccgtaccgtaaacggttcccggtaacgaaccgtaacgggtacgtaaaggtaaacgttacggttacgggttacggttaaaccgtttaacgtttttaaacgtaacgttacgttaaaccgaaacggttaaaccttaaaagttaacgtttaaaacggtttaacccgttttaaccgtttttaacccccggttttaacgggttaccccgggtaacccgggttaaaacggggtaaaacccgtttaaagggtacggttaaaacgttaccgttaaaaccgaaaaccggttaacggtaacggtaccggtaccgtaccgtactaacccttaccggttactttacccg

SEQ ID NO: 352586 - DNA, 437 bp, Homo sapiens
  misc_feature: GZ8MTXP01EWEYY.4.35.D02.1.454.CMB.2.raw
  modified_base (230)..(230): a, c, t, g, unknown or other
  misc_feature (230)..(230): n is a, c, g, or t
  modified_base (370)..(370): a, c, t, g, unknown or other
  misc_feature (370)..(370): n is a, c, g, or t
  modified_base (396)..(396): a, c, t, g, unknown or other
  misc_feature (396)..(396): n is a, c, g, or t
  modified_base (428)..(437): a, c, t, g, unknown or other
  misc_feature (428)..(437): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggancacggccaccctgaccatcagtagtgtcgaagccggtgatgagccgatattctgtcaggtgtggctactcgcagtgacctctgcgtcttcggaagtcgggaccaaggtcacccgtcttaggcagcccaaagcccaacccntgcactctcgtcccaccctctcctangtgctctgacgcgggctggcaaggcgcagtgnnnnnnnnnn

SEQ ID NO: 352587 - DNA, 603 bp, Homo sapiens
  misc_feature: GZ8MTXP01DNWHG.4.35.D02.1.454.CMB.2.raw
  modified_base (248)..(248): a, c, t, g, unknown or other
  misc_feature (248)..(248): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtattgactgganctggatccggcagtcccaagggaaggactggagtgggtggatatatcttcacaccgggaccaaccaactacaactcccctaccctacaagacgtcgactcaccccatgtcactggaaaccacttccaaagaaaccctagttacctaccctaaaattcgaaccctctgtgagcgctgacagaccacggccgtctattactgtggcgaaggactggcggggtcttagttagttgggttcggtagtacttcccgtaaggttggttttagagttagttagttagggggcccgagggggacgacgggccgggttacgaaccggttcccttacggtttccaaccggttcccttaaccccgg

SEQ ID NO: 352588 - DNA, 458 bp, Homo sapiens
  misc_feature: GZ8MTXP01DWE25.4.35.D02.1.454.CMB.2.raw
  modified_base (314)..(314): a, c, t, g, unknown or other
  misc_feature (314)..(314): n is a, c, g, or t
  modified_base (409)..(409): a, c, t, g, unknown or other
  misc_feature (409)..(409): n is a, c, g, or t
  modified_base (430)..(430): a, c, t, g, unknown or other
  misc_feature (430)..(430): n is a, c, g, or t
  modified_base (449)..(458): a, c, t, g, unknown or other
  misc_feature (449)..(458): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggatccctgcgcgattctcggggtccaactctgggagcacggccaccctgaccatcagtagtgtcgaagccggtgatgaggccgactatttctgtcaggtgtgggctactcgcagtgacctntgcgtctcggaagtgggaccaaggtcacccgtctaggtcacgccccaaaggcccaaccccatcgtccactctcgttccccacccttcctcctacngtcgcctcgtgacgcgggtcngggcaaggcgcaagtagcnnnnnnnnnn

SEQ ID NO: 352589 - DNA, 691 bp, Homo sapiens
  misc_feature: GZ8MTXP01AFH6Q.4.35.D02.1.454.CMB.2.raw
tcagagcactgtagcacgaccggtgctcgatttagcacacgatagttgggtttggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgactggagctggatccggcagtccccaagggagggactggagtgggttggatatatctttcacaccggacaccaactacaatccctcctcaagagtcgactccaccatcgtcactcggacaacttccaaacgaaccacgttactacccctaaaattcgaacccttcgtgtagacgcgctgacagaccgaccggtccgtactacttaccgtggggttcgacggtacgaacgttcgggccgggggtcttaaggtttaagttcgggggttacggggtaacgtaccgttccccgtaaggggttttacgggttttaggtaaacgtttaacgttaaaggggttcggggggttaccccggttaaggggggaaccgaacggggtccggggttaacccgtaaccccgggtttcccgttacccgtttcccggaaacccggttcccccccggg

SEQ ID NO: 352590 - DNA, 680 bp, Homo sapiens
  misc_feature: GZ8MTXP01BRIL8.4.35.D02.1.454.CMB.2.raw
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaattgtactggagctggatccggcagtcccgaagggaggactggagtgggttggatatatcttcacaccggaccacaactacaactccctcctacaagacgtcgactcaccccatcgtcactgaacactaacaacgaaaccagttacctaccctaaaattcgacctctgtgagcgctgactagaccacggccgtacgtaacttacgtacggttgggacggtaaggtaaccgtcggggtaccgggggtaccttaaggtttacggttacgggggtttaccgggggtaacggtaccgttaccccgtaggggtttaacgggttttaggttaagtttaagttacgggttacgggggaccccgggttaaggggggttaccgaacgggtcccgggttccgtaaccccggttccgtccgtttaccgaaccggttccccgttaacccccgg

SEQ ID NO: 352591 - DNA, 685 bp, Homo sapiens
  misc_feature: GZ8MTXP01CQSER.4.35.D02.1.454.CMB.2.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgngactggtgctccatcagtaatttgactgganctggatccggcagtcccaagggaaggacgtggagtgggtgatatatcttcacgaccggtaaccaccaactaacaactccctccctacaaacgagtacgactcaaccccatacgtcactcggaaacctaaccttccaaacgaaaccctaacgtttaccctaaccctaaaaacttcgaaacccttcttagtgaacgtcgactagacacgacaccgggtcctactaacgttactagtcgggcgtaacgaacgttcgggacggggtcttaagttagttacggggttaccgggaagttacgtcccgtaaaggtttgggttttagaaggtttaagttacgggttagggggtaaccggaaagggggttccttaaaggggtcccggtaccgtaaccggttccgttacggtttcccgaaccgttaacccgtttaaaccccggg

SEQ ID NO: 352592 - DNA, 574 bp, Homo sapiens
  misc_feature: GZ8MTXP01BIXNX.4.35.D02.1.454.CMB.2.raw
tcagagcactgtagcacgaccggtgctcgatttagcacacgatagttgggtttggggactttctgagagtcctggacctcctgagcaagaacatgaaacatctgtggttcttccttctcctggtggtagctcccagatgggtcctgtcccaggtgcggctgcaggagtcgggcccaggactggttaagccttcggagaccctgtccctcacctgcagtgtgactggtggctccatcagtaattgtactggagctggatccggcagtcccaagggagggactggagtgggttggatagtatctttcacaccgggaccaccaactacaatcccctccctcaagagtcgactcaccactgtcactggaccaacttccaagaaccagttacctaccctaaaattcgaaccttctgtgagcgctgcagacacggccgtctacttactgtgcggagtacgtggcggggtctagttagtgggttccgggagtatcccgaggttggtttgattgtaagttgggggacccgagggggacgcggcggtcgaccgttcgtcttcgacggtcccttccgaacccgg

SEQ ID NO: 352593 - DNA, 578 bp, Homo sapiens
  misc_feature: GZ8MTXP01DV329.4.35.D02.1.454.CMB.2.raw
  modified_base (410)..(410): a, c, t, g, unknown or other
  misc_feature (410)..(410): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaattgactggagctggatccggcagtcccgaagggaagggactggagtgggtggatatatcttcacaccgggaccaccaactacaactcccctcctacagacgtcgactccacccatgtcactgaaccacttccaagaaccagttcctacctaaattcgacctctgtgagcnctgacagacacggcctactactactgtggtcgagtacgtggcggggtcttagttagtggttcgtagggtacgtacgttcccgtaaggtttggtttggtaagttagtagggttcggggaccgttgggggaccaaggtcggtccgtaccggtcttcttcgaacgtccccg

SEQ ID NO: 352594 - DNA, 591 bp, Homo sapiens
  misc_feature: GZ8MTXP01BVF6M.4.35.D02.1.454.CMB.2.raw
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtaattgactggagctggatccggcaggtcccgaagggaagggactgggagtgggttggatatatctttcacaccgggaccaccaaactacaactccctccctcaagacgtcgactcaccccatgtcactggaacacttccaaagaaccacgttacctaccctaaaattcggacctctgtgacgcgctgcacgacacggccgtctattactgtggcgagacgtggcgggctagttagtggtcgggtagtacttcccgtaggttggtttgagttagttaggtacgggggtccgacgggggttacacgggtcggtccgtaaccggttctaccgttacgaaccgttcccgtaaccccgg

SEQ ID NO: 352595 - DNA, 742 bp, Homo sapiens
  misc_feature: GZ8MTXP01EB5ZS.4.35.D02.1.454.CMB.2.raw
  modified_base (336)..(336): a, c, t, g, unknown or other
  misc_feature (336)..(336): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaattgactggagctggatccggcagtacccgaagggaaggactggagtgggtggatatatcttcacaccggaccacaactacactccctcctacaagngtcgactcaccccatgtcactggaaaccacttaacaaacgtaacctagttacctaccctaaaattcgacctctgtacgagcgcgtgacgagaaccgtaccgggacccgttacttaactttaaccgtggttacggggaccggtaaacggtaaccgttcgggggtaccgggggtacccgtttaaacgttttaacggtttaggggggtttaccggggtaaacgggttaccgttaccccggtttaaagggggttttcggggtttttaaaggttaacgtttaaacggttaaaggggtttccggggggtacccggaaacggggggggttacttacgggggtaacccgggttaccgtaacccggggtttccttcccgttaccgtaacccgggttaaccccttaaacccccggg

SEQ ID NO: 352596 - DNA, 551 bp, Homo sapiens
  misc_feature: GZ8MTXP01AMFO1.4.35.D02.1.454.CMB.2.raw
  modified_base (540)..(551): a, c, t, g, unknown or other
  misc_feature (540)..(551): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaactccctgcgcgattcgtcggggtccaactcgtggggagccacggcccaccctgaccatcagtagtgtcgaagccggtgatggaggccgatatttcgtgtcgaggtggtgggctacgtcgctagtcgaccctcgtcgtcgttcgtttacgggaaggttcgggggaacccaaagggttccaacccccggtttcgtttaagggtccaaccggccccgaaaaacgggccccctaacccccacgttcgtacctacccttccgtccgttacccccacccccttccctaccctaacgtcgtcgtcctcgtcggacggcggggcctcgggacgaaacggccgacaaggtagnnnnnnnnnnnn

SEQ ID NO: 352597 - DNA, 583 bp, Homo sapiens
  misc_feature: GZ8MTXP01D1NF0.4.35.D02.1.454.CMB.2.raw
  modified_base (249)..(249): a, c, t, g, unknown or other
  misc_feature (249)..(249): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtaattgactgganctggatccggcagtcccaagggaaggactggaagtgggttggatatatctttcacaccggggaccaccaaactacaatcccctccctcaagacgtcgactcacccatgtcactgaacacttcaaagaccagtctcctaaaatgactctgtgagcgctgcagacacgcgtctattactgtggcgagacctggcggggtctagttagtggttcgggtagtacgtcccgtggtggttttggattagttacgttgggggcccgttaagggggacgttacgggtccgggtttaaccgggtcttcgtttccgaacgggtccccttccgtaaacccccggg

SEQ ID NO: 352598 - DNA, 648 bp, Homo sapiens
  misc_feature: GZ8MTXP01DLFGY.4.35.D02.1.454.CMB.2.raw
  modified_base (196)..(196): a, c, t, g, unknown or other
  misc_feature (196)..(196): n is a, c, g, or t
  modified_base (581)..(581): a, c, t, g, unknown or other
  misc_feature (581)..(581): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggccaggactggttaagccttcgganaccctgtccctcacctgcagtgtgacgtggtgctcatcagtaatttgactgggatcgtggactccggacaggtacccgaaggggaaggacgtggaggtgggtgatatatcttacacgaccggaccacaactacaactccctccctacaacgacgtacgactaccaccccatcgtaccactacggaaacctaccttaacccaaacgtaaaccctaacgtttaccctaaccccttaaaaacgttcgtaaacccttcgtagtacgaacgtcgcgttacgacgacgaaccgaccggtaccgtactaacttaccgtgtcgggacgacgtaacgtggacgggtacttagttaggtcgggttcgggaacgtcgtacccgtaggttggtttanagttagttaggtcggggcgaggggcaggtcgtcgtaaccgtctccttcgaaccgttccctaacccgg

SEQ ID NO: 352599 - DNA, 556 bp, Homo sapiens
  misc_feature: GZ8MTXP01CIRC6.4.35.D02.1.454.CMB.2.raw
  modified_base (419)..(419): a, c, t, g, unknown or other
  misc_feature (419)..(419): n is a, c, g, or t
tcagagcactgtagcacgaccggtgctcgatttagcacacgatagttgggtttggggggaaatactttctgagagtcctggacctcctgagcaagaacatgaaacatctgtggttcttccttctcctggtggcagctcccagatgggtcctgtcccaggtgcggctgcaggagtcgggcccaggactggttaagcccttcggagacccctgtcccctcacctgcagtgtgactggtgctcatcagtaattgactggagctggatccggcagtcccaagggaaggctggagtgggttggatatatctttcacgaccgggaccaccaactacaactcccctcctacaagacgtcgactcccaccatgtcactacggaccaacttccaaagaaccctagttcctaccctaaaatcgaccctntgtcgagcgctgcagacacggccgtctattactggtgcgagacgtggcgggctagttcgtggtcgggatcgtccaagttcggtttgattagtagtgggcgttggggcaaggcggtcacggtcttcttcgcggtcccc

SEQ ID NO: 352600 - DNA, 682 bp, Homo sapiens
  misc_feature: GZ8MTXP01ALSZP.4.35.D02.1.454.CMB.2.raw
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggacgaccctgtccctcacctgcagtgtgactggtgctccatctagttaatttgtactgggagcgtggactccggcacggtacccgaaaggggaaggacgtgggaggtggggttagatattatctttaccacgaccggaccaccaactacaactcccctcctacaagacgtaccgactcaccctatgtacactacgaacctacttccaaacgtaaccctagttaccctaacctaaattcgacctctgtgtacgcgctgacacgacaccggtccttactacttacgtggtcgggacgacggtacgtcgggcggggtacttagttaggttacggggttacgggtacgtacgttcccggttaggtttcgggtttaagttaggttaagttacggggtacgggggtaaccggaagggggttaccttaacggggtcccggttaccgtaacccggtttccgttccgttaccgtaacccgttccccgtaaccccggg

SEQ ID NO: 352601 - DNA, 736 bp, Homo sapiens
  misc_feature: GZ8MTXP01APLJT.4.35.D02.1.454.CMB.2.raw
tcagagcactgtagcacgaccggtgctcgatttagcacacgatagttggggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtcccctcacctgcagtgtgactggtgctccatcagtaattgactggagctggatccggcagtcccgaagggaagggactggaggtgggtggatatatctttcacaccgggaccaccaactacaactcccctcctcaagagtcgactccaccatgtcactagggacctaacttaccaaacgaacccacgttacctaccccgttaaaaacttcgaacccttctaggttacgacggtccgacgttacggaccaacgtaacccgaccgggtacccgttacgttaactttaaccgtgggttacggtaccggaacggtaacgtcggtccgggggtaccgttaacgtttaaaggttcggggtttaccgggggaacggttaaacgttcccccggtaaagggtttcgggttttttaggaacgtttaaacgtaaggttacggggggttaccccgttaaggggggaaccggtaacgggtccggggttaacccgtaacccggttccgttccgttttaacccgaacggttaacccccg

SEQ ID NO: 352602 - DNA, 572 bp, Homo sapiens
  misc_feature: GZ8MTXP01BHX7Q.4.35.D02.1.454.CMB.2.raw
  modified_base (487)..(487): a, c, t, g, unknown or other
  misc_feature (487)..(487): n is a, c, g, or t
tcagagcactgtagcacgaccggtgctcgatttagcacacgatagttgggtttggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtattgactggagctggatccggcagtcccgaagggaagggactggagtgggtggatatatctttcacaccgggaccaccaactacaactccctcctacaagagtcgactccaccatgtcactggacaacttaccaaagaaccagttacctaccctaaaattcgacctctgtagagcgctgcacgacacgccatctacttacgtgtgcgagacgtggcggggtcttagttcgtgggttcggacgtntcccgtaaggttgggttttgagttagtaggttcggggccgagggggaacacggtcgggtccgtacgttcctcgtttcgaacccgg

SEQ ID NO: 352603 - DNA, 573 bp, Homo sapiens
  misc_feature: GZ8MTXP01BGEYH.4.35.D02.1.454.CMB.2.raw
  modified_base (251)..(251): a, c, t, g, unknown or other
  misc_feature (251)..(251): n is a, c, g, or t
  modified_base (420)..(420): a, c, t, g, unknown or other
  misc_feature (420)..(420): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgactgganctggatccggcagtcccgaagggaagggactggagtgggttggatatatctttcacaccgggaccaccaactacaactcccctcctcaagagtcgactcacccatgtcactggaacacttccaagaaccagttcctacctaaatcgacctctagtgagcgctgcagacncggcgtctatactgtggcgagactgggcggggtctagtttagtgggttcgggtagtacgttcccgtaggtttgggtttagagttagttgtacgggggtcgacgggggcacgggtccggtcgtaaccgtctcgttacaacgcccgtaaccccgg

SEQ ID NO: 352604 - DNA, 709 bp, Homo sapiens
  misc_feature: GZ8MTXP01DJBMV.4.35.D02.1.454.CMB.2.raw
  modified_base (197)..(197): a, c, t, g, unknown or other
  misc_feature (197)..(197): n is a, c, g, or t
tcagagcactgtagcacgaccggtgctcgatttagcacacgatagttgggtttggggactttctgatagtcctggacctcctgagcaagaacatgaaacatctgtggttcttccttctcctggtggcagctcccagatgggtcctgtcccaggtgcggctgcaggagtcgggcccaggactggttaagccttcgganaccctgtccctcacctgcagtgtgactggtgctcatcagttaatttgactggagcgtggatccggcacgtcccgaaggggaaggacgtgggagtggggtggatatatcttacacgaccggaccaaccaactacaactccctaccacaagacgtcgactacaccccatacgtcactcggaaacctacttccaaacgtaaaccctagtttaccctaacccttaaaaattcgtaacccttctagtcgacgcgctacgacacgacgtaccggtcctacttaaacttcgtaggtcggacggtaacgtaccgtcgggtacgggtaccttaagtttacggttacgggttacggggtaacgttaccgttaccccggtaagggttttccggttttaaggttaatttaagggttaaggtaccgggggtacgggttaacgggggttaccacggggttcccgggtaccttaaccccggtttccgttacgtttaccccgaaccggttccccgtaaacccccgggg

SEQ ID NO: 352605 - DNA, 617 bp, Homo sapiens
  misc_feature: GZ8MTXP01DSLA0.4.35.D02.1.454.CMB.2.raw
tcagagcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtaattgactggagctggatccggcagtccccgaagggaagggactggaggtgggttggatatatctttcacaccgggaccacaactacaactccctccctacaacgacgtcgacctccaccatcgtcactggacaacttccaaagaacccagttcctaccctaaaattcgacctctgtgagcgctcgcagacacggccgtctacttactggtgcgagacgtggcgggtctagttaagttgggttcggggagtacgtccccgtaaggtttgggtttttagtagtttagttaaggttcggggggaccgttacggggggaaccgtaagggtaccgggtcctaacccgggttcttaccgttttccgaacgttcccccg

SEQ ID NO: 352606 - DNA, 616 bp, Homo sapiens
  misc_feature: GZ8MTXP01AFMQG.4.35.D02.1.454.CMB.2.raw
  modified_base (258)..(258): a, c, t, g, unknown or other
  misc_feature (258)..(258): n is a, c, g, or t
  modified_base (544)..(544): a, c, t, g, unknown or other
  misc_feature (544)..(544): n is a, c, g, or t
tcagagcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagttaattgactgganctggatccggcagtcccgaagggaggactggaggtgggtggatatatctttacacgaccggaccaaccaactacactccctcctacaagcgtcgactccaccatgtacacgtaggaacctcttacccaaagtaaccctagttacctacctaaattcgaaccttctggtcgagtccgctacgacacgaccacgggtcccttactaacttaccgtggggtacgcggagtacgtgggcgggtcttagttagtcgggttcgggagtacgttccgtaaggtttggttttanaagttagtaagggtcggggaccggttaggggacctaagggcgtccgtaccgtcttacttccgaacgtccccg

SEQ ID NO: 352607 - DNA, 650 bp, Homo sapiens
  misc_feature: GZ8MTXP01DZELL.4.35.D02.1.454.CMB.2.raw
  modified_base (385)..(385): a, c, t, g, unknown or other
  misc_feature (385)..(385): n is a, c, g, or t
tcagagcactgtagcacgaccggtgctcgatttagcacacgatagttggggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggacgaccctgtcccctcacctgcagtgtgactggtgctccatcagttaatttgactggagcgtggatccggcagtcccgaaagggaagggacgtggagtgggtggatatatctttcacgaccggaccaccaactacaactccctcctacaacgacgtcgactccaccatcgtcacgtcgaacnctaccaaacgacctacgttacctaacctaaaacttcgaccttctgtacgacgcgacgttcgactacgaccgtaccggcccgttacttacgtttaaccgtggggtacgacggtaacggtaaccgtcgggtacggggtaccgtttaagttacggttcggggttaccgggtacgtacgttcccgtaaggtttggtttagagttacgtaggttcggggacgaggggaccaaggtccggtaactaccggtcttccgttcgaacgtccccg

SEQ ID NO: 352608 - DNA, 563 bp, Homo sapiens
  misc_feature: GZ8MTXP01BY24O.4.35.D02.1.454.CMB.2.raw
  modified_base (249)..(249): a, c, t, g, unknown or other
  misc_feature (249)..(249): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtattgtactgganctggatccggcagtcccgaagggaaggacgtggagtgggtgatatatcttcacaccgggaccaccaactacaactcccctccctacaacgagtacgactcaccccatgtcactggaacaccttcaagaaccagttacctaccctaaatcgaaccctctagtcagcgctgacagacacggccgtctattactgtcggcgagactggcgggtctagttagtgggtcggtagtactccgtaggttggtttgagttagttaggtcggggcgagggggcaggtcggtcgtaaccgtctcgttctaacgcctaaccccgg

SEQ ID NO: 352609 - DNA, 752 bp, Homo sapiens
  misc_feature: GZ8MTXP01BOI0L.4.35.D02.1.454.CMB.2.raw
  modified_base (251)..(251): a, c, t, g, unknown or other
  misc_feature (251)..(251): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagttaattgactgganctggatcggcagtacccgaagggaggcgtggagtgggtgatatatcttcacgaccggaccacaactacactcccctcctacaacgacgtcgactcaacccctatcgtacacgtacggaaacctaacccttaaccgaaacgtaaaccctaacgtttaccctaaccccttaaaagttcgggtacccttcgtacgtacggtaacgccgtactgaaccgacggtaaccaccggggaccgttacgtaacttaccgttcgggttcgggacgggtaacgtaccggttcgggacccgggggtactttaacggtttaaggttacggggttacggggtaacgttaccggttaccccgttaagggtttcgggttttaggttaaacggtttaacggtttaggggtaccgggggtcccgggttaaagggggttccgttaaacgggggtaaccgggttccgttaacccgggttccttaccgtttacccgaaccggttaacccctaacccccgggg

SEQ ID NO: 352610 - DNA, 622 bp, Homo sapiens
  misc_feature: GZ8MTXP01DDTBV.4.35.D02.1.454.CMB.2.raw
  modified_base (250)..(250): a, c, t, g, unknown or other
  misc_feature (250)..(250): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtaatttgactgganctggatccggcagtcccgaagggaagggactggagtgggtggatatatctttcacaccggaccaccaactacaactcccctcctcaacgacgtcgactcaccccatgtcactggaaccacttccaaagaaaccagttacctaccctaaaatcgaccctctgtgagcgctgacagacacggcctcgtaacttacgtgtgggacgaacgtctcgggacggggtcttagttagttacggggttcggtagtaccgtacccgtaggtttcgggttttagagttacgttaggttacgggggacccgttaaggggggttacacggggtccggttaccgtccggttacgttccgtttccgaacgttcccgttaaccccgg

SEQ ID NO: 352611 - DNA, 561 bp, Homo sapiens
  misc_feature: GZ8MTXP01AOK8G.4.35.D02.1.454.CMB.2.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (248)..(248): a, c, t, g, unknown or other
  misc_feature (248)..(248): n is a, c, g, or t
  modified_base (371)..(371): a, c, t, g, unknown or other
  misc_feature (371)..(371): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaanccttcggagaccctgtccctnacctgcagtgtgactggtgctcatcagtattgactgganctggatccggcagtcccaagggaagggctggagtgggttggatatatctttcacaccgggaccaccaactacaactccctccctcagatcgactcacccatgtcactggaacaccttccaaanaaacccagttcctaccctaaaattcgaaccctctagtgacgcgtctgacacgacacggccgttctaattactgtcggcgagtactggcgggctagtagtggtcggagtactccgagttggtttgatagttagtggggacccgagggggacacgggccggtctaaccggtctcgttcaacgccctaacccg

SEQ ID NO: 352612 - DNA, 761 bp, Homo sapiens
  misc_feature: GZ8MTXP01CH6QL.4.35.D02.1.454.CMB.2.raw
tcagagcactgtagcacgaccggtgctcgatttagcacacgatagttgggtttggggactttctgatagtcctggacctcctgagcaagaacatgaaacatctgtggttcttccttctcctggtggcagctccagatgggtcctgtcccaggtgcggctgcaggagtcgggcccaggactggttaagccttcggacgaccctgtcccctcacctgcagtgtgactggtgctccatcagttaattgactggagtcgtggactccggcgacggtaccccgaaaggggaagggacgtagggaggtggggttaggaattagtattctttacgaaccgaacccggggaaccaacccaaactaccaacgttccccctaccctacaaagacgtaccgactaccaaccccatacgtacacgtacggaaacctaccttcccaaacgaaaccctacgtttaccctaacccttaaaaacttcgaacccttcgtagtacggaacggcgtaccgttacgaccgtaacgaccgtaacccgggtaccgttaccgttaaacgttacgtaggttacgggacggtaacggtaacgtcggggtaccggggttaaccttaaggtttacggttacggggttaccggggtaacgtaccgttacccggttagggttttaacgggttttagaaggttaggttacgggtaccggggtacggacggggttcgacgggtccggtaccgtaaccgttccgtcgttacgtaaccgttcccgtaaccccgg

SEQ ID NO: 352613 - DNA, 674 bp, Homo sapiens
  misc_feature: GZ8MTXP01AI7K5.4.35.D02.1.454.CMB.2.raw
  modified_base (253)..(253): a, c, t, g, unknown or other
  misc_feature (253)..(253): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggtagctcccagatgggtcctgtcccaggtgcggctgcaggagtcgggcccaggactggttaagccttcggagaccctgtccctcacctgcagtgtgactggtggctccatcagttaattgtactgganctggatccggcgacgtacccgaagggaagggacgtgggaggtgggttggatatatctttcacgaccggaccaccaactacaactcccctaccacaacgagtacgactacacctatcgtcactacgacaaccttaccaacgaacctacgtttacctacccgtaaaattcgaaccttcgtagtcgagcgctgacgacgaccgtaccggccgttactacgttacgtcgtacggacgggagtacgttgggacggggtacttaacgttaggttcgggtttacggggacgtacgttaccccgtagggtttggttttaagaagttaggttacgggttcgggggacccggtaagggggttacgttacgggttccgggtccctaccggttccgttacccgttccgaccggtcccttaaccccgaacccgg

SEQ ID NO: 352614 - DNA, 578 bp, Homo sapiens
  misc_feature: GZ8MTXP01DLW6N.4.35.D02.1.454.CMB.2.raw
  modified_base (445)..(445): a, c, t, g, unknown or other
  misc_feature (445)..(445): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgactggagctggatccggcagtcccgaagggaggctggagtggtgatatatcttcacaccggaccaccaactacaactcccctaccctacaagacgtcgactcacccatagtcactggaaaccacttcccaaagaaccctaagttacctaaccctaaattgaccctctgtgagcgctagcgagacgacggccgtctattacngtggacgagacgtggcgggtcttagttagtggttcggagtacgtccgtgtttggtttgagttagttaggtcggggacgttaagggggcagggtccggtactaacccgttctccgttcgcgttcccgtaacccg

SEQ ID NO: 352615 - DNA, 554 bp, Homo sapiens
  misc_feature: GZ8MTXP01ES2VY.4.35.D02.1.454.CMB.2.raw
  modified_base (258)..(258): a, c, t, g, unknown or other
  misc_feature (258)..(258): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggtagctcccagatgggtcctgtcccaggtgcggctgcaggagtcgggcccaggactggttaagccttcggagaccctgtccctcacctgcagtgtgactggtgctcatcagtattgactggagctgatccggnagtcccaagggaggactggagtgggttggatatatctttcacgaccggaccaccaactacaactccctaccctacaacgagtcgactacaccactgtcactgacctaacttaccaagacctagttcctaccctaaaatcgactctgtcgagcgctgcagacacggcgtctactacgtgcgcggaagacgtggcgggtacttaagttagtgggtacgggagtacgtccgtaggttggtttgattagtgttacggggcgaaggggcaggcgtcgacgtctcgtcacgccttcgaaccg

SEQ ID NO: 352616 - DNA, 593 bp, Homo sapiens
  misc_feature: GZ8MTXP01CZH5V.4.35.D02.1.454.CMB.2.raw
  modified_base (194)..(194): a, c, t, g, unknown or other
  misc_feature (194)..(194): n is a, c, g, or t
  modified_base (326)..(326): a, c, t, g, unknown or other
  misc_feature (326)..(326): n is a, c, g, or t
  modified_base (365)..(365): a, c, t, g, unknown or other
  misc_feature (365)..(365): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctccagatgggtcctgtcccaggtgcggctgcaggagtcgggccaggactggttaagccttgganaccctgtccctcacctgcagtgtgactggtgctccatcagtaatttgactggagctggatccggcaggtcccaagggaaggacgtggagtggtggatatatcttcacacggaccacaactacactccctccncagactcgactcaccccatgtcactgaacacttccaaanaacctacgtacctaccctaaatcgacctctgtagacgcgcctgacacgacacgggtcctactattactgtggcgtagtaccgtggcggggcttaagttagttcgggttcgggtacgtacgttacccgtaggtttgggttttcgagttagttaacggttcggggacccgttaaggggcgttaggtaacccggtcgtaacccgtctaccgttcaacggttccctaacccg

SEQ ID NO: 352617 - DNA, 733 bp, Homo sapiens
  misc_feature: GZ8MTXP01AM8Q7.4.35.D02.1.454.CMB.2.raw
tcagagcactgtagcacgaccggtgctcgatttagcacacgataggttggggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggacgaccctgtccctcacctgcagtgtgactggtgctcatcagtaattgtactggagctggatccggcagtcccgaaggggaagggactggaggtgggttggatatatctttcacgtaccgggaccaccaactacaactcccctacctcaagacgtcgactccaccatgtcactggaactcttaccaaacgaacctagttcctacccttaaaattcgaacccttcgtgtcgagtccgcttcggacacgaaccgaccgggtcccgttacttaactttaacccgtggggttacgaccggtaacgaacggttcggggtccgggggtaacctttaaggttttaacggttcgggggtttaccgggggtaagttaacccgtttccccgggtaagggttttacgggggttttttaggaaaccgtttagggtttaaacggggtcggggggttaccccgaaaggggggacctaacgggggacccgggttcccgtaaaccccggggtttccttccgtttaaccgccgggttaaccccccg

SEQ ID NO: 352618 - DNA, 669 bp, Homo sapiens
  misc_feature: GZ8MTXP01B9DRP.4.35.D02.1.454.CMB.2.raw
  modified_base (251)..(251): a, c, t, g, unknown or other
  misc_feature (251)..(251): n is a, c, g, or t
  modified_base (650)..(650): a, c, t, g, unknown or other
  misc_feature (650)..(650): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgactggancgtggacgtccggacacgtacccgaagggaaggacgtgggagtgggtgatatatctttacacgaccggaccaaccgaactaaccactacccctccctacgaacgacgtccgactacgaccccatcgtacactacggaaactaccttaaccgaaacgtaaaccctagtttaccctaacccttaaaattcgaaaccttctagtagacgtcgcttacgacaacgacgtaccgggtcctacttaacttacgtacgttcggacgtaggtacgtcggtcgggtaccttaggttagtacggggttcggtagtaccgtccgtaggtttcgggtttagagttagttacggttcgggggacggttacggggacgttacggtccggtcgtaacccgtttcctacgttccncccgttcccgtaaccccgg

SEQ ID NO: 352619 - DNA, 578 bp, Homo sapiens
  misc_feature: GZ8MTXP01CJGDN.4.35.D02.1.454.CMB.2.raw
  modified_base (566)..(566): a, c, t, g, unknown or other
  misc_feature (566)..(566): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgactggagctggatccggcagtcccgaagggaagggactggagtgggttggatatatctttcacaccgggaccaaccaactacaactcccctccctacaaacgacgtcgactcaaccccatcgtcactggaacacttccaaagaaaccagttactaccctaaaattcgaccctactgtagagcgctgacagacacggccgtctaattactgtggcgagtactggcggggtctagttagtgggttacgggagtacgtcccgtaggttggtttgatagttaggttcggggccgaggggcacgggcggtcctaacggtctcgttcncgccgtaacccg

SEQ ID NO: 352620 - DNA, 663 bp, Homo sapiens
  misc_feature: GZ8MTXP01B6Z74.4.35.D02.1.454.CMB.2.raw
  modified_base (252)..(252): a, c, t, g, unknown or other
  misc_feature (252)..(252): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgactgggancgtggactccggcacggtcccgaaggggaaggacgtggagtgggttgatatatcttcacgaccggaccaccaactacactccctccctacaagatcgactccacccatgtcactcggaaccacttccaaacgaaacctacgttcctacctaaaacttcgaacctctgtgacgacgctgacgacgtaccgaccggtaccgttctaacttaccgtgttacggggacggtacggtaccgttcgggaccgggggtacttacgttaacgggtttacggggttcgggtaacggtaccgtccccgttagggtttaagggtttttgaaagtttagttacgggtcgggggaccggttagggggacacgggtccgggtacgtaacccgttcttccgttacgtaaccgcccgttaaccccgg

SEQ ID NO: 352621 - DNA, 599 bp, Homo sapiens
  misc_feature: GZ8MTXP01BYEBZ.4.35.D02.1.454.CMB.2.raw
  modified_base (250)..(250): a, c, t, g, unknown or other
  misc_feature (250)..(250): n is a, c, g, or t
  modified_base (405)..(405): a, c, t, g, unknown or other
  misc_feature (405)..(405): n is a, c, g, or t
tcagagcactgtagcacgaccggtgctcgatttagcacacgatagttgggtttggggactttctgatagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaattgactgganctggatccggcagtcccgaagggaggactggagtgggtggatatatcttcacaccgggaccaccaactacaactcccctcctacaagacgtccgactccacccatgtcactggaaccacttccaaagaccagttcctaccctaaaattcgacctntgtgagcgctgacagacacggccgtactaacgttactggttcggacggtacgtaccgtgggtccggggtacttagtttaagtcggggttaccgggtagtacgttcccgtaggttcggttttagagttagttaggtcggggacgagggggttcacgggtcgtctaaccggtctcttcgaacgttcccgtaacccg

SEQ ID NO: 352622 - DNA, 714 bp, Homo sapiens
  misc_feature: GZ8MTXP01CYHZN.4.35.D02.1.454.CMB.2.raw
  modified_base (502)..(502): a, c, t, g, unknown or other
  misc_feature (502)..(502): n is a, c, g, or t
  modified_base (541)..(541): a, c, t, g, unknown or other
  misc_feature (541)..(541): n is a, c, g, or t
tcagagcactgtagcacgaccggtgctcgatttagcacacgatagttgggtttgggggggaaatactttctgagagtcctggacctcctgagcaagaacatgaacatctgtggttcttccttctcctggtggcagctcccagatgggtcctgtcccaggtgcggctgcaggagtcgggcccaggactggttaagccttcggagaccctgtcccctcacctgcagtgtgactggtgctccatcagttaattgtactggagcgtggactccggacacgtacccgaaggggaaggacgtgggaggtggggttaggattagtaacttcctttaccgaaccgaaccccgggacccaaaccaaacctaactaacccttccccctaccgtacaaacgacgtccgaaccttcccaaccctatcggtaccacgttacggaacctccttaacccgaaacgtaaaccctacgttacctaaccctaaaattcgaaccttctaggtcgaacgtcncgtagaccagaccgaacggtccgtacttactttaccggngggtcgacgtacgtacggtgggtaccggtattaggttacgggtacgggttacggtacgtccgttccgttaagggtttcggtttagtaaacgttacggttacggggtcggggaacggttacggggaccgtcgggtccgtaacccgtccgttcttaccgttaacgccgtaacccg

SEQ ID NO: 352623 - DNA, 627 bp, Homo sapiens
  misc_feature: GZ8MTXP01ACCXR.4.35.D02.1.454.CMB.2.raw
  modified_base (251)..(251): a, c, t, g, unknown or other
  misc_feature (251)..(251): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgactggancgtggatcggcagtcccgaagggaaggactggagtgggttggatatatctttcaccgtaccgggaccaccaaactaccaactcccctccctcaagacgtcgactcacccatgtacactggaacacttccaaagaaccctagttacctaccctaaaattcgaccttctacgtagagcgtactgacagacacggtccgtactatacgtgtacggcgagacgtcggcggggtacctagttacgttcgggttacggagtaacgttcccgtaaggttggttttagagttaagttaggttacgggggcccggttaagggggttacgttacggtaaccggtcgtaacccgtcgttcgttaccgtccgaacccgttaaccccgg

SEQ ID NO: 352624 - DNA, 572 bp, Homo sapiens
  misc_feature: GZ8MTXP01BH818.4.35.D02.1.454.CMB.2.raw
  modified_base (251)..(251): a, c, t, g, unknown or other
  misc_feature (251)..(251): n is a, c, g, or t
  modified_base (440)..(440): a, c, t, g, unknown or other
  misc_feature (440)..(440): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagttaattgactgganctggatccggcagtcccgaagggaaggactggagtgggtgatatatcttcacaccggaccacaactacaactccctcctcagagtcgactcaccccatcgtcactggaaaccacttccaaacgaaccctagttacctaccctaaaattcgtacctctgtgagcgctgacagacgcggcctctatactgngcgagactggcggggtcttagttagtgggttcggtagtactccgtaggttggttttgagttacgttaggtgggggaccgaggggcttagggccggtccgaaccgttctcttaccgcgttcccgtaaccccgg

SEQ ID NO: 352625 - DNA, 617 bp, Homo sapiens
  misc_feature: GZ8MTXP01BVB2N.4.35.D02.1.454.CMB.2.raw
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggtagctcccagatgggtcctgtcccaggtgcggctgcaggagtcgggcccaggactggttaagccttcggagaccctgtccctcacctgcagtgtgactggtgctccatcagtattgactggagctggatccggcagtccgaagggaggatggagtggtggatatatcttnacgaccggaccaccaactacactccctccnaagagtcgactcaccactcgtcacgtcggacctaaccttaccaagaaccctagttacctaccctaaaattcgacctctacgtgacgcgctgcacgacgacggtccgtacttagttaccgtgtcggacggacgtcgtgggcggggtacttaagttcggtgggttacgggagtaccgtcccgtaggtttggtttcgaagttacgtagggttcggggacgtacgggggacgttcgggttcgggtaaccgtcccgtaaccgttcgtccgaccgtccccgttaaccgtaaccccgg

SEQ ID NO: 352626 - DNA, 625 bp, Homo sapiens
  misc_feature: GZ8MTXP01AR9II.4.35.D02.1.454.CMB.2.raw
  modified_base (195)..(195): a, c, t, g, unknown or other
  misc_feature (195)..(195): n is a, c, g, or t
  modified_base (436)..(436): a, c, t, g, unknown or other
  misc_feature (436)..(436): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctccagatgggtcctgtcccaggtgcggctgcaggagtcgggccaggactagttaagccttcgganaccctgtccctcacctgcagtgtgactggtgctcatcagttaattgactggagctggatccggcacgtccgaagggaggactggagtgggtggatatatcttcacgaccgggaccaccgaactacgaacttccccgtaccctacgaaacgacgtaccgactccaacccctatcgtacaacgtggaaaccaaccctttccaaacggaaccctagttcctaaccctaaaattcgaacctcgtntgacgcgtctgacagtacacggccgtactattactgtacggcgaggactacgggcggggtacttagttacggttgggttacgggagtacctaccgtgttcggtttaagagttacgttaggtcggggacgacggggacttcggtaacggtcgtaaccggtcttcgttacgaaccgttcccgtaaccccgg

SEQ ID NO: 352627 - DNA, 646 bp, Homo sapiens
  misc_feature: GZ8MTXP01BRHAU.4.35.D02.1.454.CMB.2.raw
  modified_base (249)..(249): a, c, t, g, unknown or other
  misc_feature (249)..(249): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggacgaccctgtccctcacctgcagtgtgactggtgctcatcagtattgactgganctggactccggcagtcccgaagggaggacgtggagtgggtggatagtatcttacacgaccggaccaccaactacactcccctcctacacgacgtcgactcaccccatgtacacgtcgaaactaccttaaccgaaacgaacctacgttaccctaccttaaattcgtaacctctagtcgagcgtactgacgacgaccgtaccggtccgttacttacgttacgtcggtagggacggacggtaacggttcgggccgggttacgttacgtttaggtacggggttacgggtacgtacgttcccgtaggtttggttttagagtttaggttaggtcggggacggttacggggcacgggtccgggtacctaaccgggttcttccgttactcccgcccgtaaccccg

SEQ ID NO: 352628 - DNA, 522 bp, Homo sapiens
  misc_feature: GZ8MTXP01BN4TD.4.35.D02.1.454.CMB.2.raw
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (516)..(522): a, c, t, g, unknown or other
  misc_feature (516)..(522): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatatcgaccggccctcaggaactccctgcgcgacttcgtcggggtccaactcgtgggagcaccggcccacctgaccatcagtgtgtcgaagccgtgatggagcgacttattctgtcgaggtgtgggctacgtcgcagtcgaccttcgtggtcccgttcgtttacgggaacggttggggaaccctaagggtcctaaccccggttcttaacgggtcaaccggaccccaaacgggaccccaacccccgactcgtacctacctcgttccgttccccaccccgttccctacctaacgngtcnccttcgtcggtacggccggacgtcggacgaacggcgacagtagnnnnnnn

SEQ ID NO: 352629 - DNA, 553 bp, Homo sapiens
  misc_feature: GZ8MTXP01E1ZI3.4.35.D02.1.454.CMB.2.raw
  modified_base (188)..(188): a, c, t, g, unknown or other
  misc_feature (188)..(188): n is a, c, g, or t
  modified_base (251)..(251): a, c, t, g, unknown or other
  misc_feature (251)..(251): n is a, c, g, or t
  modified_base (540)..(540): a, c, t, g, unknown or other
  misc_feature (540)..(540): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaanccttcggagaccctgtccctcacctgcagtgtgactggtgctccatcagtaattgtactgganctggatccggcagtcccaagggaagggactggagtgggttggatatatctttcacaccgggaccaccaactacaatcccctccctcaagagtcgactcaccccatgtcactggaacacttccaaagaaccagttctccctaaaattgacctctgtgagcgctgcagacacggccgtctattactgtggcgagactggcgggggcctagttatgggttcgggagtactcccgaggtcgggttttgatagttagtggggcccgaggggcaggcggtcaaccggtctcttcncgccgtaaccccg

SEQ ID NO: 352630 - DNA, 441 bp, Homo sapiens
  misc_feature: GZ8MTXP02JWTIZ.4.35.D02.1.454.CMB.2.raw
  modified_base (346)..(346): a, c, t, g, unknown or other
  misc_feature (346)..(346): n is a, c, g, or t
  modified_base (437)..(441): a, c, t, g, unknown or other
  misc_feature (437)..(441): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggagtggaccaggtcacccgtntaggtcagcccaaggcccaccccatgtcactctcgttccccaccctcctccctacagtcgctctgacgcggggctgggcaaggcgcatagnnnnn

SEQ ID NO: 352631 - DNA, 438 bp, Homo sapiens
  misc_feature: GZ8MTXP02JAM8L.4.35.D02.1.454.CMB.2.raw
  modified_base (371)..(371): a, c, t, g, unknown or other
  misc_feature (371)..(371): n is a, c, g, or t
  modified_base (434)..(438): a, c, t, g, unknown or other
  misc_feature (434)..(438): n is a, c, g, or t
tcagagcactgtagcacgaccggtgctcgatttagcacacgatagttgggtttggggtttcatgagtgcagggagacggccaggattacttgtggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcacccgtctaggtcagcccaaggccaccccntgtcactctcgttcccaccctcctcctacagtcgctctgacgcgggctggcaaggcgcatagnnnnn

SEQ ID NO: 352632 - DNA, 437 bp, Homo sapiens
  misc_feature: GZ8MTXP02HJ7NB.4.35.D02.1.454.CMB.2.raw
  modified_base (316)..(316): a, c, t, g, unknown or other
  misc_feature (316)..(316): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
  modified_base (434)..(437): a, c, t, g, unknown or other
  misc_feature (434)..(437): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgacccatcagtagtgtcgaagccggtgatgaggccgactatttctgtcaggtgtgggctactcgcagtgacctntgcgtcttcggaagtgggaccaaggtcacccgtntagtcagccaaggccaccccntgtcactctcgtccccaccctcctcctacagtcgctctgacgcgggctggcaaggcgcatagnnnn

SEQ ID NO: 352633 - DNA, 550 bp, Homo sapiens
  misc_feature: GZ8MTXP02G812T.4.35.D02.1.454.CMB.2.raw
  modified_base (361)..(361): a, c, t, g, unknown or other
  misc_feature (361)..(361): n is a, c, g, or t
  modified_base (407)..(407): a, c, t, g, unknown or other
  misc_feature (407)..(407): n is a, c, g, or t
tcagagcactgtagcacgaccggtgctcgatttagcacacgatagttgggtttgggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtattgactggagctggatccggcagtccaagggaggactggagtggtgatatatctttcacaccgggaccaccaactacaactccctcctcaagagtcgactccaccatgtcactgacncttccaagaaccagttacctaccctaaaattcgacctctgtgagcnctgcagacacgcgtctattactgtgcgagacgtgcgggactagttagtgggttcgggagactacccgtaggttggttttagattagtagtcggggaccgtaggggacaagggtcgtacgaccggtctccttcgacggtccccg

SEQ ID NO: 352634 - DNA, 561 bp, Homo sapiens
  misc_feature: GZ8MTXP02HM9R0.4.35.D02.1.454.CMB.2.raw
tcagagcactgtagcacgaccggtgctcgatttagcacacgatagttgggtttggggactttctgatagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgtactggagctggatccggcagtcccaaggaagggactggagtgggtggatatatctttcacaccgggaccaccaactacaactccctccctcaagagtcgactcacccatgtcactggacacttccaaagaccagttcctaccctaaaattcgacctctgtgagcgctgcagacacggccgtctattactgtgcgagactggcggggctagttacgtgggttcgggagtactcccgtaagttcggttttagattagttaagtcggggaccgagggggacaggcggtcaccggttctactttcgacgtcctaaccccg

SEQ ID NO: 352635 - DNA, 579 bp, Homo sapiens
  misc_feature: GZ8MTXP02JU4SL.4.35.D02.1.454.CMB.2.raw
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgactggagctggatccggcagtcccaagggaagggactggagtgggttggatatatctttcacaccggaccaccaactacaactccctcctcaagagtcgactcacccatgtcactgacacttccaagaaccagttctaccctaaaattcgaaccctctgtgtagcgactgcagacacggccgtctattactcgtgcgagactggcggggtctagttagtgggtttcgggagtaagtcccgaaggtttcggttttagaagttacgtaagttcgggggccgtaagggggactaacggcggtaccgaaccggtcttccgtttcgacggtccctacccg

SEQ ID NO: 352636 - DNA, 540 bp, Homo sapiens
  misc_feature: GZ8MTXP02GGVYH.4.35.D02.1.454.CMB.2.raw
  modified_base (370)..(370): a, c, t, g, unknown or other
  misc_feature (370)..(370): n is a, c, g, or t
tcagagcactgtagcacgaccggtgctcgatttagcacacgatagttgggtttgggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgactggagctggatccggcagtcccaagggaagggactggagtgggttggatatatctttcacaccgggaccaccgaactacaatccctccctcaagatcgactccaccatgtcactggacncttccaaagaccagttctaccctaaaattcgacctctgtgagcgctgcagacacggccgtctattactgtgcgagactgcggggctattagtgggttcggagatcccgagttcggtttgattatagtggggacctaggggacaaggcggtcaccgtctcttcgacgtccc

SEQ ID NO: 352637 - DNA, 442 bp, Homo sapiens
  misc_feature: GZ8MTXP02G8TGX.4.35.D02.1.454.CMB.2.raw
  modified_base (349)..(349): a, c, t, g, unknown or other
  misc_feature (349)..(349): n is a, c, g, or t
  modified_base (435)..(442): a, c, t, g, unknown or other
  misc_feature (435)..(442): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgacccatcagtagtgtcgaagccggtgatgaggccgactatttctgtcaggtgtgggctactcgcagtgacctctgcgtcttcggaagtggaccaaggtcacccgtntaggcagcccaaggcccacccatgtcactctcgttccccaccctcctcctacagtcgctctgacgcgggctggcaaggcgcatagnnnnnnnn

SEQ ID NO: 352638 - DNA, 527 bp, Homo sapiens
  misc_feature: GZ8MTXP02GKGFJ.4.35.D02.1.454.CMB.2.raw
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (395)..(395): a, c, t, g, unknown or other
  misc_feature (395)..(395): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtaattgactgganctggatccggnagtcccaaggaggactggagtgggttggatatatctttcacaccgggaccaccaactacaatccctcctcaagagtcgactcaccccatcgtcactggacacttccaagaaccagttctaccctaaaatgacctntgtgagcgctgcagacacgccgtctattactgtgcgagactggcggggctagtagtggttcggagactcccgagtggtttgatagtagtcgggcgaggggacagcggtcacggtctcgttcacgcctacccg

SEQ ID NO: 352639 - DNA, 594 bp, Homo sapiens
  misc_feature: GZ8MTXP02HEWY5.4.35.D02.1.454.CMB.2.raw
  modified_base (251)..(251): a, c, t, g, unknown or other
  misc_feature (251)..(251): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaattgtactgganctggatccggcagtcccaagggaaggactggagtgggttggatatatctttcacaccggaccaccaactacaatccctccctacaagagtcgactcacccatgtcactggacacttccaaagaaccagttacctaccctaaaattcgaacctctagtgagcgctgcagacacggccgtctattactgtgcgtagactggcggggactagttaagtgggttacgggagtactcccgtaggttggttttagtagttacttaaggttcgggggacccgaacgggggtacgtaaggccggttcgaaccccggttcgttcctttaccgaacgtccccgtaacccccgg

SEQ ID NO: 352640 - DNA, 570 bp, Homo sapiens
  misc_feature: GZ8MTXP02GZXYR.4.35.D02.1.454.CMB.2.raw
  modified_base (203)..(203): a, c, t, g, unknown or other
  misc_feature (203)..(203): n is a, c, g, or t
  modified_base (458)..(458): a, c, t, g, unknown or other
  misc_feature (458)..(458): n is a, c, g, or t
tcagagcactgtagcacgaccggtgctcgatttagcacacgatagttgggtttggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcgganaccctgtccctcacctgcagtgtgactggtgctccatcagtattgactggagctggatccggcagtcccaagggaggactggagtgggttggatagtatctttcacaccgggaccaccaactacaatccctctctcaagacgtcgacctcaccatgtcactggaccacttccaaagaaccagtttctaccctaaaattcgacctactgtagagtacgctcgcacgacacggccgtactattactgtgcgtagacnggcggggcttagtagtggtgggagtactaccgtaggttggtttacgattacgttagtcgggggacccgtaggggaacgtggtaccggtcaccggttctacggtttcacccgg

SEQ ID NO: 352641 - DNA, 604 bp, Homo sapiens
  misc_feature: GZ8MTXP02GV8KU.4.35.D02.1.454.CMB.2.raw
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtcccccactgcagtgtgactggtggctccatcagtaattgtactggagctggatccggcagtcccgaagggaaggactgggagtgggtgatatatcttcacgaccggaccaccaactacaactcccctccctacaagacgtacgactccaccactcgtccactggacctaccttaccaagaaccctagttaccctaacccgtaaaattcgaacctctagtgagcgctcgcacgacacggccgtactactactgtgacgacgacgtggcggggtacttagttagtcgggttcgggagtacgtacccgtaggttcggtttagattagttacggtcggggaccggagggggtacaggtccggtaacgtaccgttcgtacgttcgacgtcccgtaccgaacccgg

SEQ ID NO: 352642 - DNA, 562 bp, Homo sapiens
  misc_feature: GZ8MTXP02JZ313.4.35.D02.1.454.CMB.2.raw
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaattgactggagctggatccggcagtcccaagggaggactggagtgggtggatatatctttcacaccgggaccaccaactacaatccctcctcaagagtcgactcacccatgtcactggacacttccaanaaccagttcacctaaaatgacctctgtnagcgctgcagacacggccgtctattactgtgcgagactggcggggctagtttagtgggttcggggagtacgtccccgaaggttggttttagattacgttagtcgggggtacccaagggggtacaaggccggtcgaccggtctaccgttcaacggtccctaaccccg

SEQ ID NO: 352643 - DNA, 568 bp, Homo sapiens
  misc_feature: GZ8MTXP02HDG48.4.35.D02.1.454.CMB.2.raw
  modified_base (250)..(250): a, c, t, g, unknown or other
  misc_feature (250)..(250): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaattgactgganctggatccggcagtcccaagggaagggactggagtgggttggatagtatctttcacaccggaccaccaactacaactccctccctcaagacgtcgactcaccccatgtcactggacacttccaagaaccagttacctaccctaaaatcgaacctctgtgagcgctcgcagacacggccgtctattactgtgcgagactggcgggctagtagtgggtcggagtacgtcccgtaaggttcggtttagatagtaggtcgggggacccgtagggggacgaggccggtacgacccggtcttacgtcgtacgtccctaaccccg

SEQ ID NO: 352644 - DNA, 551 bp, Homo sapiens
  misc_feature: GZ8MTXP02IVNLW.4.35.D02.1.454.CMB.2.raw
  modified_base (249)..(249): a, c, t, g, unknown or other
  misc_feature (249)..(249): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtatttgactgganctggatccggcagtcccgaagggaagggactggaggtgggttggatatatcttcacgaccggaccaccaactacaactccctccctacaagagtcgactcacccatcgtcactgaccacttccaagaaccagttacctaccctaaaattcgacctactgtacgagcgctgcacgacacgccgtactattactgtgcgagactgggcgggcttagttagtggtcgggagtacgtccgtagttggtttagatagtagtcggggtccgaggggcaggcgtcgtaccgtctctcgacgcctacccg

SEQ ID NO: 352645 - DNA, 450 bp, Homo sapiens
  misc_feature: GZ8MTXP02IAK9X.4.35.D02.1.454.CMB.2.raw
  modified_base (285)..(285): a, c, t, g, unknown or other
  misc_feature (285)..(285): n is a, c, g, or t
  modified_base (368)..(368): a, c, t, g, unknown or other
  misc_feature (368)..(368): n is a, c, g, or t
  modified_base (401)..(401): a, c, t, g, unknown or other
  misc_feature (401)..(401): n is a, c, g, or t
  modified_base (436)..(436): a, c, t, g, unknown or other
  misc_feature (436)..(436): n is a, c, g, or t
  modified_base (443)..(450): a, c, t, g, unknown or other
  misc_feature (443)..(450): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgatatttcngtcaggtgtgggctactcgcagtgacctctgcgtcttcggagtggaccaggtcacccgtctaggtcagcccaaggcccacccnctgtcactctcgttccccaccctccctcttacngtcgctcgtgacgccgggtctgggacgaacgggcncataggnnnnnnnn

SEQ ID NO: 352646 - DNA, 457 bp, Homo sapiens
  misc_feature: GZ8MTXP02GMR4Q.4.35.D02.1.454.CMB.2.raw
  modified_base (385)..(385): a, c, t, g, unknown or other
  misc_feature (385)..(385): n is a, c, g, or t
  modified_base (405)..(405): a, c, t, g, unknown or other
  misc_feature (405)..(405): n is a, c, g, or t
  modified_base (445)..(457): a, c, t, g, unknown or other
  misc_feature (445)..(457): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattcctcggggtccaactctgggagcacggccaccctgaccatcagtagtgtcgaagccggtgatgaggccgactattctgtcaggtgtgggctactcgcagtgacctctgcgtctcggagtggaccaaggtcacccgtctaggtcagcccaaggccaccccgatgtcactctgttccncgcccctcctcctacagtcnctctaggcggtccgggctcggacgaaacgggccatagtgnnnnnnnnnnnnn

SEQ ID NO: 352647 - DNA, 610 bp, Homo sapiens
  misc_feature: GZ8MTXP02I64QY.4.35.D02.1.454.CMB.2.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactagttaagccttcgganaccctgtccctcacctgcagtgtgactggtgctccatcagtaattgactgganctggatccggcagtcccaagggagggactggagtgggttggatatatctttcacaccgggaccaccaactacaatccctccctcaagagtcgactcacccatgtcactggacacttccaagaaccagttcctccctaaaattcgacctctgtgagcgctgcagacacggccgtactatactgtgcgagactggaccggggcttagttacgtgggttacgggagtacgtcccgtaggtttacgggttttgaaagttacgtaaggttcgggggaccccgtaaggggggacctacgggtaaccggggttccgtaaacccggtttccgttccgtttaccgtaacggtcccctttaaacccccgg

SEQ ID NO: 352648 - DNA, 598 bp, Homo sapiens
  misc_feature: GZ8MTXP02H5LTG.4.35.D02.1.454.CMB.2.raw
  modified_base (335)..(335): a, c, t, g, unknown or other
  misc_feature (335)..(335): n is a, c, g, or t
  modified_base (409)..(409): a, c, t, g, unknown or other
  misc_feature (409)..(409): n is a, c, g, or t
tcagagcactgtagcacgaccggtgctcgatttagcacacgatagttgggttggggggaaatactttctgagagtcctggacctcctgagcaagaacatgaaacatctgtggttcttccttctcctggtggcagctccagatgggtcctgtcccaggtgcggctgcaggagtcgggcccaggactgggttaagccttcggagaccctgtccctcacctgcagtgtgactggtgctcatcagtaatttgactggagctggatcggcagtcccaagggaagggactggagtgggtggatatatctttcacaccgggacacgaactacaatccctccnaagacgtcgactcccacatgcactgaccacttacaaagaacctacgttacctaccctaaaatttcgaaccttcngtcgacgcgctagacagaacgacgccgtctaaacttcgtgtgcgagacgtggacgggtctaattagtgggttcggaagtacgtaccgtaggttagggttttgaacttagtaaggttcggggggacccgtaagggggtacgaacgggtcgggttaccgaccggttccgttctttaccgaacggtcccccg

SEQ ID NO: 352649 - DNA, 561 bp, Homo sapiens
  misc_feature: GZ8MTXP02GHEBU.4.35.D02.1.454.CMB.2.raw
  modified_base (217)..(217): a, c, t, g, unknown or other
  misc_feature (217)..(217): n is a, c, g, or t
  modified_base (373)..(373): a, c, t, g, unknown or other
  misc_feature (373)..(373): n is a, c, g, or t
  modified_base (447)..(447): a, c, t, g, unknown or other
  misc_feature (447)..(447): n is a, c, g, or t
tcagagcactgtagcacgaccggtgctcgatttagcacacgataggttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctnacctgcagtgtgactggtgctcatcagtaattgactggagctggatccggcagtcccaagggaagggactggagtgggttggatatatctttcacaccgggaccaaccgaactacaatccctccctcaagagtcgactccaccatgtcactggacncttccaaagaaaccagttacctaccctaaaattcgaccctctgtgagcgctgcagacacggccgtactattacngttgcgagactggcggggtctagttagtggttcgggagtacgtcccgtaggttggtttaggattagtacgttggggaccgaggggacaaggcggtcaccgtctctcgacgtccc

SEQ ID NO: 352650 - DNA, 587 bp, Homo sapiens
  misc_feature: GZ8MTXP02H02W7.4.35.D02.1.454.CMB.2.raw
  modified_base (263)..(263): a, c, t, g, unknown or other
  misc_feature (263)..(263): n is a, c, g, or t
  modified_base (405)..(405): a, c, t, g, unknown or other
  misc_feature (405)..(405): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagacctgtccctcacctgcagtgtgactggtgctccatcagttaatttgtactggagctggatccggnagtcccgaagggaagggactggagtgggttggatatatctttcacgaccggaccaccaactacaactcccctcctcaaagacgtacgactcacccatcgtcactgactactcaagactagtacctacctaaatcgacctctntgagcgctgctagacacgccgtatacttacgtgtgcgagacctggtcggggacttagttagttgggtcgggtagtacgtcccgtaggttacggtttgaagttagtaggttacggggacccgtaaggggacgacggtaacggtccgtaacccggtctccgttaccgacgttccctaaccccgg

SEQ ID NO: 352651 - DNA, 654 bp, Homo sapiens
  misc_feature: GZ8MTXP02JMOG7.4.35.D02.1.454.CMB.2.raw
  modified_base (377)..(377): a, c, t, g, unknown or other
  misc_feature (377)..(377): n is a, c, g, or t
tcagagcactgtagcacgaccggtgctcgatttagcacacgatagttgggtttggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaattgactggagctggatccggcagtcccgaagggaaggactggagtgggtggatatatctttcacaccgggaccaccaactacaactcccctcctacaacgacgtcgactcccaccgatcgacactggaacncttaccaaagaacctagttcctacctaaaattcgacctctgtacgagcgctgcagacacggccgtctacttactcgtgacgagtacgtcggcggggtacttagtttagttacgggttacggggtaacggtacgttaaccccggttaagggtttcggggtttttaggaacgttaacggtttaaagggttcgggggacccggggttaaagggggaccgaacgggtccggggttaccgtaacccgggtttacccttccgtttaccgaacggtttcccccg

SEQ ID NO: 352652 - DNA, 538 bp, Homo sapiens
  misc_feature: GZ8MTXP02JP99M.4.35.D02.1.454.CMB.2.raw
  modified_base (248)..(248): a, c, t, g, unknown or other
  misc_feature (248)..(248): n is a, c, g, or t
  modified_base (432)..(432): a, c, t, g, unknown or other
  misc_feature (432)..(432): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtattgactgganctggatccggcagtcccaaggaagggactggagtgggttggatatatctttcacaccgggaccaccaactacaatcccctccctcaagagtcgactcaccccatgtcactggacacttccaagaaccagttcctccctaaaattgacctactgtgagcgctgcagacacggccgtctattaccngtgcgtagactgcgggctattagtggttcggagactcccgagttcggtttgattagtagtcggggacctagggggacaggcggtcaccgtctctcacgcctacccg

SEQ ID NO: 352653 - DNA, 548 bp, Homo sapiens
  misc_feature: GZ8MTXP02J2TT3.4.35.D02.1.454.CMB.2.raw
  modified_base (250)..(250): a, c, t, g, unknown or other
  misc_feature (250)..(250): n is a, c, g, or t
  modified_base (328)..(328): a, c, t, g, unknown or other
  misc_feature (328)..(328): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaattgactgganctggatccggcagtcccgaagggaagggactggagtgggttggatatatcttcacaccggacaccaactacactcccncctcaagactcgactcaccccatgcactcgacacttccaaagaacctagtcctacctaaaattcgacctctgtagagcgctgcagacacggccgtctacttactgtcgcgagacgtgggcggggtctagtttagtcggggttacgggagtacgtcccgtagtttcggtttagatacgtaagtgggcgacgggacacgcgtcacgtctcgtcacgctaccg

SEQ ID NO: 352654 - DNA, 454 bp, Homo sapiens
  misc_feature: GZ8MTXP02FKED0.4.35.D02.1.454.CMB.2.raw
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (443)..(454): a, c, t, g, unknown or other
  misc_feature (443)..(454): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttcngtcaggtgtgggctactcgcagtgacctntgcgtcttcggaagtgggaccaaggtcaccccgtcttaggtcagcccaaggcccacccccactcgtcacctctcgttccccgccctcctcctacacgtgctctgacgcgggctggcaaggcgcatagnnnnnnnnnnnn

SEQ ID NO: 352655 - DNA, 578 bp, Homo sapiens
  misc_feature: GZ8MTXP02FPHUD.4.35.D02.1.454.CMB.2.raw
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagagcactgtagcacgaccggtgctcgatttagcacacgatagttgggtttggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaattgtactggagctggatccggcagtcccaagggagggactggagtgggttggatatatctttcacaccgggaccaccgaactacaatccctcctacaagagtcgactccaccatgtcactggacnctccaanaatcagttactaccctaaaattgacctctgtgagcgctgcagacacgccgtctactactgtgcgagactgcggggactagttagtggttacggggagtacgtcccgtaggttaggtttacgtagtaacgttaagttcggggtccgaagggggaacgtaacggtccgggtaccgacccggttcgtacctttcgaacccgg

SEQ ID NO: 352656 - DNA, 460 bp, Homo sapiens
  misc_feature: GZ8MTXP02IZ4TW.4.35.D02.1.454.CMB.2.raw
  modified_base (433)..(433): a, c, t, g, unknown or other
  misc_feature (433)..(433): n is a, c, g, or t
  modified_base (441)..(460): a, c, t, g, unknown or other
  misc_feature (441)..(460): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgagccgactattctgtcaggtgtgggctactcgcagtgacctctgcgtcttcggaagtggaccaaggtcacccgtctaggcagcccaaggccaccccatgtccactctcgttccccacccttccctcctacagtcgccttctgacgcgggctgggcaagggcncaatcggnnnnnnnnnnnnnnnnnnnn

SEQ ID NO: 352657 - DNA, 613 bp, Homo sapiens
  misc_feature: GZ8MTXP02HL5YY.4.35.D02.1.454.CMB.2.raw
  modified_base (462)..(462): a, c, t, g, unknown or other
  misc_feature (462)..(462): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaattgtactggagctggatccggcagtcccgaagggaggactggagtgggtggatatatctttcacaccggaccaccaaactacaactccctccctacaagacgtcgactcaccccatgtcactggacctacttccaaagaaccctacgttcctaacccttaaaatcgaccctactgtagagcgctgacagacgacggccgtactattactgtgacgagtacgngggcgggtcttagttagttcggggttcgggagtacgtacccgtaggtttcgggtttagtagttaaagttacggtacgggggacccgtaagggggtacctagggccggttacgacccggttctacgtttccgaaccggtccctaaaccccgg

SEQ ID NO: 352658 - DNA, 535 bp, Homo sapiens
  misc_feature: GZ8MTXP02GFOCW.4.35.D02.1.454.CMB.2.raw
  modified_base (249)..(249): a, c, t, g, unknown or other
  misc_feature (249)..(249): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
  modified_base (464)..(464): a, c, t, g, unknown or other
  misc_feature (464)..(464): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtaattgactgganctggatccggcagtcccaaggaagggactggagtgggttggatagtatctttcacaccgggaccaccgaactacaatccctccctcaagagtcgactcaccccatgtcactggacacttccaanaccagttctcctaaaattgaacctntgtgagcgctgcagtacacgccgtactattactgtgcgagactgcggggtctagtctggttcgganagtccctagtcgtttagattagtagtggggtccaggggtacaggtcgtcaccgtcgtcttcacgctacccg

SEQ ID NO: 352659 - DNA, 684 bp, Homo sapiens
  misc_feature: GZ8MTXP02IQXPN.4.35.D02.1.454.CMB.2.raw
  modified_base (252)..(252): a, c, t, g, unknown or other
  misc_feature (252)..(252): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagttaattgtactggancgtggactccggcacgtcccgaagggaggacgtggaggtggtggatatatcttcacgaccggacaccaactacaactccctcctacaagagtcgactcacccatcgtcactgacacttccaaagaacctacgttacctacctaaattcgacctctagtgagcgctagacacgacgaccggaccgttctaacgttaccgtgttcggacgtagtacgtcgggtaccggggtaccttaaggttaggttacggggtttacggggacgttaaccgttacccggtaagggttttacgggtttttaggtaaagtttaaacggttaaaggggtttccgggggtaccgggaaacggggggtaaccgtaacgggtcccggggttaccgtaacccggtttccgttaacccgtttcccgaaaccggtttcccctaaacccccgg

SEQ ID NO: 352660 - DNA, 599 bp, Homo sapiens
  misc_feature: GZ8MTXP02GNOS0.4.35.D02.1.454.CMB.2.raw
  modified_base (251)..(251): a, c, t, g, unknown or other
  misc_feature (251)..(251): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgactgganctggatccggcagtcccaaggaagggactggagtgggtggatatatctttcacgaccggacaccaactacaatccctccctacaagagtcgactcacccatgtcactggacacttccaagaaaccagttacctacctaaaaattcgaaccctactgtagagcgctgcagacacgcgtctattacngtncganacgtgcggggctagttagtggtttacggagtaacgtcccgaaggttcggttttaggaattacgtaaaggttcggggaccgtaagggggacgaacggtccgggttaccgaacccgggttaccgttcctttaccgaaccggtcccttaaacccccggg

SEQ ID NO: 352661 - DNA, 639 bp, Homo sapiens
  misc_feature: GZ8MTXP02ISDKX.4.35.D02.1.454.CMB.2.raw
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagttaatttgtactggagctggatccggcacgtcccgaagggagggactggaggtgggtgatatatctttcacgaccggaccaaccaactacaactcccctcctacaacgagtccgaactccaacccatctctacgtaggacctacttccgaaagtaacccagtttaccctaaccctaaaatttacgacccttacttggtcgtacgccgcgttacgacgaaccggaccgtaccgggccgtttacttaactttacgttggtcggacggagtaccgtggggacccggggtcttagttacggttgggtacgggatacgtccgtaggtttcggtttagattagtaggtacggggaccgtagggacgacggtcggtactacggtctcgtttaccgcgtccgtaacccg

SEQ ID NO: 352662 - DNA, 651 bp, Homo sapiens
  misc_feature: GZ8MTXP02FV2XY.4.35.D02.1.454.CMB.2.raw
  modified_base (250)..(250): a, c, t, g, unknown or other
  misc_feature (250)..(250): n is a, c, g, or t
  modified_base (425)..(425): a, c, t, g, unknown or other
  misc_feature (425)..(425): n is a, c, g, or t
tcagagcactgtagcacgaccggtgctcgatttagcacacgatagttgggtttggggactttctgatagtcctggacctcctgagcaagaacatgaaacatctgtggttcttccttctcctggtggcagctcccagatgggtcctgtcccaggtgcggctgcaggagtcgggcccaggactggttaagccttcggacgaccctgtccctcacctgcagtgtgactggtgctcatcagtatttgactgganctggactccggcacgtcccgaagggaggcgtggaggtggtggatatatcttcacgaccggaccaccaactacaactcccctacctacaacgagtaccgactcaacccctatcgtacacgtcgaacctacttaccaaacgaacctacgttacctaacccttaaaatcgaacccttntgtacgagaccgctagacgacgacgacggtcctacgtattacgtgtcgcgagtacgtgggacgggtacttaggttagtcgggttacggacgtacgtaccggtaggtttcgggtttagaagttacggtaacgggttacgggggaccggtaacgggggtactacggggtccggttaccgtaacccggtttccgttacccgtacgtacccggtaccccgttaaccccgg

SEQ ID NO: 352663 - DNA, 594 bp, Homo sapiens
  misc_feature: GZ8MTXP02HNE58.4.35.D02.1.454.CMB.2.raw
  modified_base (519)..(519): a, c, t, g, unknown or other
  misc_feature (519)..(519): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagttaattgactggagctggatccggcacgtacccgaagggaagggactggaggtggttgatatatcttcacgaccggaccacaactacaactccctacctacaagacgtccgaactcaaccctatcgtcactgaccaacttccaaagaaacctacgttacctaacccttaaaatcgaccctactgtacgacgcgctgacagacgaccggccgtactattactgtgcgagactgggacggtctagtagtcgggttacggagtaactccgtaaggttcggtttanagttagtacgggtcggggaccgaaggggacaggtccggtcaaccggtcttaccgttccaacggttcccaacccgg

SEQ ID NO: 352664 - DNA, 462 bp, Homo sapiens
  misc_feature: GZ8MTXP02JUDKW.4.35.D02.1.454.CMB.2.raw
  modified_base (379)..(379): a, c, t, g, unknown or other
  misc_feature (379)..(379): n is a, c, g, or t
  modified_base (411)..(411): a, c, t, g, unknown or other
  misc_feature (411)..(411): n is a, c, g, or t
  modified_base (451)..(462): a, c, t, g, unknown or other
  misc_feature (451)..(462): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctggggagcacggccaccctgacccatcagtagtgtcgaagccggtgatgaggccgactatttctgtcagggtgtgggctacgtcgcagtgacctcgtgcgttcttcggaagtgggaccaaggtcacccgtcttagcacgcccaaggcccaccccntgtccactctcgtccccgccctcctccctacngtcgcctcgtgacgccgggtctgggcaagggcgcagtagnnnnnnnnnnnn

SEQ ID NO: 352665 - DNA, 671 bp, Homo sapiens
  misc_feature: GZ8MTXP02JVMRF.4.35.D02.1.454.CMB.2.raw
  modified_base (197)..(197): a, c, t, g, unknown or other
  misc_feature (197)..(197): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcgganaccctgtccctcacctgcagtgtgactggtgctcatcagttaattgtactggagctggactccggcagtacccgaaaggggaaggacgtggaggtgggtagatatatcttcaccgaccggaccaaccaactacaactccctcctacaagacgtcgactacaccccatcgtacacgtgaccacttaccaaacgaacctacgttacctaacctaaaaactttcgaacccttcgtacgtaggaacgtcgactcgacaacgtaccgaccgggtaccgttacttaacgttaaccgtggttacgacggaggtaaccgtcggggacgggggtaccttaaaggtttacgttagggggttacgggaagtaccgtacccgtaggtttacggtttagaagttaagtacggggtcggggaccgaagggggactacggggtaaccgtaccgtaccggtcttccgtaccgacgtaccccgtaacccgg

SEQ ID NO: 352666 - DNA, 455 bp, Homo sapiens
  misc_feature: GZ8MTXP02FSKAD.4.35.D02.1.454.CMB.2.raw
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (381)..(382): a, c, t, g, unknown or other
  misc_feature (381)..(382): n is a, c, g, or t
  modified_base (395)..(395): a, c, t, g, unknown or other
  misc_feature (395)..(395): n is a, c, g, or t
  modified_base (434)..(455): a, c, t, g, unknown or other
  misc_feature (434)..(455): n is a, c, g, or t
tcagagcactgtagcacgaccggtgctcgatttagcacacgataggttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccacctgaccatcagtagtgtcgaagccggtgatgagccgactattctgtcaggtgtgggctactcgcagtcgacctntgcgtcttcggagtggacaaggtcacccgtntagcagcccaagcccacccgntgtcactctgttccnncccctctccctanagttcgctcgtgacggcggtcaggaccgaggccatagannnnnnnnnnnnnnnnnnnnnn

SEQ ID NO: 352667 - DNA, 656 bp, Homo sapiens
  misc_feature: GZ8MTXP02ISAQM.4.35.D02.1.454.CMB.2.raw
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagttaatttgtactgganctggatccggnagtcccaaggaaggctggagtgggttggatagtatctttcacgaccggtaccaccgaactacaactcccctcctacgaacgagtaccgactccaccccatcgtacctactggaacctacctttccgaaagtaacccagtttaccctaccccttaaaaattcgaaccctgtcgtggacgtcgactgactacgacgaccggccgttactagttacgtcgttcgacgacgtactcggggtaccggggacttacgttagttcgggttacgggataacgtacccgtggtttacgggttttagagttaagtacggttacgggggacccggtaagggggtcgaacgggtccggtaccgtacccggttcttaccgtttccgacggtaccccttaacccgg

SEQ ID NO: 352668 - DNA, 451 bp, Homo sapiens
  misc_feature: GZ8MTXP02F7OU6.4.35.D02.1.454.CMB.2.raw
  modified_base (315)..(315): a, c, t, g, unknown or other
  misc_feature (315)..(315): n is a, c, g, or t
  modified_base (349)..(349): a, c, t, g, unknown or other
  misc_feature (349)..(349): n is a, c, g, or t
  modified_base (404)..(404): a, c, t, g, unknown or other
  misc_feature (404)..(404): n is a, c, g, or t
  modified_base (444)..(451): a, c, t, g, unknown or other
  misc_feature (444)..(451): n is a, c, g, or t
tcagagcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgatatttctgtcaggtgtgggctacgtcgcagtgacctntgcgtcttcggaagtgggaccaaggtcacccgtntaggtcacgcccaaggcccacccatcgtcactctcgttcccaccctcctctaacngtcgctcgtgacgcgggcctggaccaaggccgacagtagnnnnnnnn

SEQ ID NO: 352669 - DNA, 595 bp, Homo sapiens
  misc_feature: GZ8MTXP02GFZFL.4.35.D02.1.454.CMB.2.raw
  modified_base (297)..(297): a, c, t, g, unknown or other
  misc_feature (297)..(297): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtaattgtactggagctggatccggcagtcccaagggaggactggagtggtgatatatcttnacaccggacacaactacaactccctcctcaaagacgtccgactcaaccccatcgtcactggaaccacttccaaacgaacctagttacctaaccctaaaattcgaacccttctgtagacgcgactgacacggacacgggtcctactattactgtgcgagactggcgggacttagtcgtgggtcggaatacgtacccgtaggttcggtttagatttaggtaacgttcggggacgtaacgggggacaaggggtccggtaccgtaccggttctaccgtttaccgacggtccccttaacccgg

SEQ ID NO: 352670 - DNA, 569 bp, Homo sapiens
  misc_feature: GZ8MTXP02FTAPA.4.35.D02.1.454.CMB.2.raw
  modified_base (252)..(252): a, c, t, g, unknown or other
  misc_feature (252)..(252): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctccatcagtaatttgtactgganctggatccggcagtcccaaggaagggactggagtgggtggatatatctttcacaccgggaccaccaactacaactcccctccctcaacgagtcgactcacccatgtcactggaccacttccaaagaacctagttacctaccctaaaaatttgaaccctctcgtgagcgctgcagacacggcctctattactgtgcgagaccgtggcggggtcgtattagtgggttacgggagactcccgtaggttagggtttgaagttactaaggttcggggccgaaggggacgaaggcggtcgaaccgtctcttcacgcctacccg

SEQ ID NO: 352671 - DNA, 647 bp, Homo sapiens
  misc_feature: GZ8MTXP02JXHFX.4.35.D02.1.454.CMB.2.raw
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
  modified_base (335)..(335): a, c, t, g, unknown or other
  misc_feature (335)..(335): n is a, c, g, or t
tcagagcactgtagcacgaccggtgctcgatttagcacacgatagttgggtttggggactttctgagagtcctggacctcctgagcaaagaacatgaaacatctgtggttcttccttctcctggtggcagctcccagatgggtcctgtcccaggtgcggctgcaggagtcgggcccaggactgggttaagccttcggagaccctgtccctcacctgcagtgngactggtgctcatcagttattgactgganctggatccggcagtacccaagggagggactggagtgggttgatatatcttcacgaccggacaccaactacaactccctccctanaacgactcgactccgacccatgtcacgtgtacacttccaaacgaacctacgttacctaaccttaaaacgtttcgtaaccctctacgttagacgtcgtcgtagacacggaccgaaccggtccgttacttatttaccgtgtacgacgtagacgtcgggacggggtaccttaagtttacggtggggttaccgggagtaaccgttcccgaaggtttcggttttagaagttagttaacgggtcgggggaaccgtagggggaccaaggggtccgtccggtaaccggttcttacccttaccgacggtccctaaccccgg

SEQ ID NO: 352672 - DNA, 647 bp, Homo sapiens
  misc_feature: GZ8MTXP02JXTBM.4.35.D02.1.454.CMB.2.raw
tcagagcactgtagcacgaccggtgctcgatttagcacacgatagttgggtttggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgacgtggtgctccatcagttaatttgactggagcgtggagtccggcacgtacccgaaagggaagggacgtggtaggtgggttgatatatctttcacgaccggaccaccaactaacactccctcctacgaagacgtccactacccacctatcgtaccacgtcgactaccttaccaacgtaaacctacgttacctaccttaaaacttcgaacctctacgtagacgccgctacgacacgacgacgccgttacgtacttactacggtcgtacggtagtacgtggtaccggggtacttaggttcgtacggggttacgggtacgtacgtacccgttaggttaggtttagtagttagtacgggtacggggccggaacggggtacgaaggtccggtacgtaccggttcgtccgttaccgacgtaccccg

SEQ ID NO: 352673 - DNA, 699 bp, Homo sapiens
  misc_feature: GZ8MTXP02GNK49.4.35.D02.1.454.CMB.2.raw
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggacgaccctgtccctcacctgcagtgtgactggtgctcatcagttaattgtactggacgtcgtggactccggacacggtacccgaaaggggagggactgggagtgggtagatatatcttcacgaccggaccaccaactacaactccctcctacaagcgtaccactcacccatgtacacgtgaacctacttacaaacgaacctacgttaccctaacccttaaaattcgtaccctacgtgttacgacgtcgctacgacgaacgtaccgacccggttccgtacttacgttaaccgtggttacgaccggtaagtaccggtcgggtacggggtactttaagtttaggttacggggttacggaaggttccttaccggtagggtttacggtttagtaagtttaacggttagggttaccgggggaccggaacgggggtaccgtaacgggtcccggtttaaaccgacccggtttccgtaccgtttaccgaccgtaccccgtttaaacccccggg

SEQ ID NO: 352674 - DNA, 624 bp, Homo sapiens
  misc_feature: GZ8MTXP02FM0F0.4.35.D02.1.454.CMB.2.raw
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggtagctcccagatgggtcctgtcccaggtgcggctgcaggagtcgggcccaggactggttaagccttcggacgaccctgtccctcacctgcagtgtgactggtgctcatcagttaattgacngganctggactccggcagtacccgaagggaaggacgtgggaggtggttaggatatatctttacacgaccggaccaccaactaccactccctaccctacaagacgtcgactccacactcgacactacgacacttaccacgaacctacgttacctaaccttaaaattcgaacctgtacgtgacgcgtacgtgcaagaccgacggtccctattacgttacgtggtcgacgtacgtacgtgggtaccggggtacttaagttacggttgggttaccgggtagtaccgttaccgtaggtttcggtttacgagttacgtagggtcggggaccgaggggacaggtccgtaacgaccgttctcgtacgaccgaccgtcaaacccgg

SEQ ID NO: 352675 - DNA, 653 bp, Homo sapiens
  misc_feature: GZ8MTXP02HABD2.4.35.D02.1.454.CMB.2.raw
  modified_base (248)..(248): a, c, t, g, unknown or other
  misc_feature (248)..(248): n is a, c, g, or t
  modified_base (353)..(353): a, c, t, g, unknown or other
  misc_feature (353)..(353): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtattgactggancgtggatccggcacgtccgaagggaggactggagtgggtgatagtatcttcacgacggaccaacaactacaactccctacctacaacgacgtccgactcaccccntcgtcactggacacttcgaaagacctagttacctaaccctaaaattcgaaccctgtagtacgacgccgtcacgacacggaccgaaccggtccgtacttaacgttacgtcggtgaccgtaagacctgggggtacccggggtactttaagttacggttcggggtttacgggaacgtaaccgttcccggtaaaggttttcgggtttagaattacggtttagggtacgggggtaacgaacgggggtacaacgggtccggtaccgtaccggttcttaccgttacgaccggttacccaaaccccgg

SEQ ID NO: 352676 - DNA, 630 bp, Homo sapiens
  misc_feature: GZ8MTXP02I7VKK.4.35.D02.1.454.CMB.2.raw
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (415)..(415): a, c, t, g, unknown or other
  misc_feature (415)..(415): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggacgaccctgtccctcacctgcagtgtgactggtgctcatctagtattgactggatctggatccggcacgccgaaagggaggactggagtggtgatntatcttnacgacggacacatacactccctactnaacgngtcgactcacccntacgcacgtcgacaccttacaaacgaacctacgttacctaaacccttaaaattcacccttctagtagtacgcncgtgacgacgaaccgtcggtaccgttacttaagttaccgtggtagaccggaagtcccgtaggggacggggttaaccttaggttacggttcgggggttacgggtaagtaccgtttaccggtaagggtttcggttttaagagtttaacggtaaggtcgggggaccgtaagggtcgacggcgggtcctaccggtcttcgtactaccgtacccaaccgg

SEQ ID NO: 352677 - DNA, 808 bp, Homo sapiens
  misc_feature: GZ8MTXP02I7JUA.4.35.D02.1.454.CMB.2.raw
  modified_base (269)..(269): a, c, t, g, unknown or other
  misc_feature (269)..(269): n is a, c, g, or t
tcagagcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaacgccttcggagaccctgtccctcacctgcagtgtgactggtgctcatcagttattgactggagctggactccggnacgtccgaagggaggacgtggaggtgggtgagtatatcttcacgacggaccacaactacactccctcctacaacgacgtcgactacccaccatcgtacactaggactaccttaccaacgtaacctacgttaccctacccttaaaaacttcgtaacccttacgttacggttacgacggtaccgtacgttacggacccgtaaggacccgtaaccgggtaccccgttaacgttaactttaaccggttacggttacgggtaccgggtaaaccggtaccgggttacgggggtaccgggggttaccgtttaaacggttttaaacgggggtttacgggggtttaaccgggggtaaacgggtacccggtttaacccccgggtttaaggggttttaacggggttttttaccggtaaacgggtttaagttaacgggggttccgggggtaaacccggggtaacgggggtaacggtaaccggggtaccgggttaacccggtacccgggttaaccgtttcccggtttaccgtaaccccggttaaccccccgg

SEQ ID NO: 352678 - DNA, 849 bp, Homo sapiens
  misc_feature: GZ8MTXP02H68WV.4.35.D02.1.454.CMB.2.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
tcagagcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaanccttcggagaccctgtccctcacctgcagtgtgactggtgctcatcagtattgactgganctggatcggcagtaccgaagggaggacnggagtggtgatatatctttcacgaccggaccaccgaaactacaaactcccctacctacaagactacgactcccaccatcgtacacgtggaacctaccgttaccaaacgaaaccctacgtttacccttaacccttaaaatttccaacccttacgtacggtttacggaacggtcccgtacccgtttacggacccgaaaggtaacccccggtaacccggggttaccccggttacctttaaaaccggtttaccccgttaggggttaccgggtaccggtaaacgggttaacccgggtgggggtacccccggggggttatttaaccgggttttaaagggtttcggggggttttacccgggggaaaagggttaaacccgtttcccccgggttaaaaggggtttttcggggtttttaaacggttaacgtttaaagggttaaaacggggtttccggggggaaacccggggttaacgggggaaacccggttaaccggggtaccgggtttaacccccggttaaacccgggtttaccctttccggtttttaaccccgaccccgggtttaaaccccccg

SEQ ID NO: 352679 - DNA, 670 bp, Homo sapiens
  misc_feature: GZ8MTXP02JRKJO.4.35.D02.1.454.CMB.2.raw
  modified_base (252)..(252): a, c, t, g, unknown or other
  misc_feature (252)..(252): n is a, c, g, or t
  modified_base (363)..(363): a, c, t, g, unknown or other
  misc_feature (363)..(363): n is a, c, g, or t
  modified_base (482)..(482): a, c, t, g, unknown or other
  misc_feature (482)..(482): n is a, c, g, or t
tcagagcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcgatcagttaattgtactggancgtggagtccggcagtacccgaaggggtaacggcgtggagtgggttagatatattcttcacgtaccggaccaaccaactacactccctcctacacacgtcactcacccctntacgtctacgtgacctacgtaccaacgtaacctacgttacctaaccctaaaatttccgaaaccttctggttacgacggtcgtcgagtccaaggacgaccggtacctcgttaacttacgngttacggacgagacgtacgggtacgggtaccttagttaaccggttggggttacggacggtacgtccgtagggtttacgtttacgacgttaggtacggttacggggtacccgaaggggttaccgacggttccgggggtaccttaacccgggttcttaccgggtttaacccgtacccgtaccctaaccgg

SEQ ID NO: 352680 - DNA, 689 bp, Homo sapiens
  misc_feature: GZ8MTXP02GC134.4.35.D02.1.454.CMB.2.raw
tcagagcactgtagcacgaccggtgctcgatttagcacacgatagttgggtttggggactttctgagagtcctggacctcctgagcaagaacatgaaacatctgtggttcttccttctcctggtggcagctccagatgggtcctgtcccaggtgcggctgcaggagtcgggcccaggactggttaagccttcggagaccctgtccctcacctgcagtgtgactggtgctcatcagtatttgactggagctggactccggcagtcccaaagggaggactggagtggtggatagtatcttcacaccggaccaaccaactacaactcccctcctacaagacgtcgactcaccctatgtacactaggacctactccaaacaaaccctagttaccctacccttaaaattcgtacccttactgttacgagtaccgcgtcgacgaaccgaacgtaacccggggccttaccgttaacttacgtggtacggtacgaaggtaccgttacggggacggggtccttaaaggtttaggtacgggggtttacgggaagtacgttaccccgttagggtttacgggtttttaggaaatttacggtaacggtcgggggtaccggaacgggggaacctaaggggtcccggttaccgtaaacccgggttcttaacccgtttcgaacccgggtcccttaaacccccggg

SEQ ID NO: 352681 - DNA, 463 bp, Homo sapiens
  misc_feature: GZ8MTXP02G1SQC.4.35.D02.1.454.CMB.2.raw
  modified_base (291)..(291): a, c, t, g, unknown or other
  misc_feature (291)..(291): n is a, c, g, or t
  modified_base (315)..(315): a, c, t, g, unknown or other
  misc_feature (315)..(315): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
  modified_base (453)..(463): a, c, t, g, unknown or other
  misc_feature (453)..(463): n is a, c, g, or t
tcagagcactgtagcacgaccggtgctcgatttagcacacgatagttgggttttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattcgtcgggggtccaaactctgggagcacggccaccctgaccatcagtagtgtcgaacgcggtgatgacggccgactatttcngtcaggtgtgggctactcgcagtnacctctgcgtcttacggagtagggaccaaaggtcaccccgtcttaggtcacgcccaacggcccaccccgatcgtccactcctacgtcccccaccctcctcctacagtcnctcctgcgcggctggcaggccaanatagnnnnnnnnnnn

SEQ ID NO: 352682 - DNA, 595 bp, Homo sapiens
  misc_feature: GZ8MTXP01EKFAW.4.1.A01.1.454.CMB.2.raw
  modified_base (272)..(272): a, c, t, g, unknown or other
  misc_feature (272)..(272): n is a, c, g, or t
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttcctgtaaggcctctggatatacgttcaattaactatgctatccagttgggncaccacggacccccaacaaacctgacgtggatggggttgatcaagtggtagaaactaggaaaaaaccaatattacacgagcttacccagggcagatgaaaccatcccgtacccgggacaaccgactcccggacgacgacgaccaatctaatcgtaggaaactgacgccgcctgactatctgacgagtacgtcggactagttattagttttcgaggtgacggaaggngggaagggggaaggngttgggtaggagggtaactttggttacttcgaattaacttacgtttgaaccctggttcgggaacccgaacggggtaaccccg

SEQ ID NO: 352683 - DNA, 519 bp, Homo sapiens
  misc_feature: GZ8MTXP01DG3ES.4.1.A01.1.454.CMB.2.raw
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccacggcccccggacaaaacctgacgtggatggggttgatcaatggtagaaactggaaaaaccaatattcacgagcttccaggcagaatgaacccatctcccgggacacactccgcgagcgcaatctaatctggaaactgacgccgcctgacatctgcgagcgtcgcagtatatttctgtgcgagaggnggggaagngttggtgagggtattgttattcatntattgacngttgggccngggtaaccg

SEQ ID NO: 352684 - DNA, 634 bp, Homo sapiens
  misc_feature: GZ8MTXP01AUQR5.4.1.A01.1.454.CMB.2.raw
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttcctgtaaggcctntggatatacgttcattaactatgctatccattgggncgccgacggcccccgaanaaacctgacgtggatggggttgatcaagtggtagaaactaggaaaaaaccaattacttacaaccgagtccttacccgagggtacaagaaatcgaaaccctattcccgacccgggaacaccacgtcccgacgacgaccgacaattctaatccgtaggaaacctcggacgcccgtacctagacctatctgaccgagtaccgttcggacgtagtattatttcgtgtcgcggtagagggagggggtaagaggttgggttaggaaggggtatttggttacttccgttaattaacgttacgtttcggaacccgtacgggttaccggggaacccgttaacggggtaaccccgg

SEQ ID NO: 352685 - DNA, 650 bp, Homo sapiens
  misc_feature: GZ8MTXP01ELCZE.4.1.A01.1.454.CMB.2.raw
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (439)..(439): a, c, t, g, unknown or other
  misc_feature (439)..(439): n is a, c, g, or t
  modified_base (497)..(497): a, c, t, g, unknown or other
  misc_feature (497)..(497): n is a, c, g, or t
tcagagcactgtagcacgaccggtgctcgatttagacgtctcatcagggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttccngtaaggcctctggattatacgttcaattaactatgctatccattgggncgccgacggcccccggaacaaaccgtgacgtggagtgggtgatcaagtggtagaaacgtaggaaaaaaccaatattacacgagcttacccgagggcaagaatcgaaaccatcccgtaccgggacacactcccgacgagcgacaattctatcgtaggaactgacgcccnctagacctagtctgacgagtaccgtcggacctagttaattacgttttcgtggttacgngggaaggtaggggaagggggaaggttaggttgggggtttaacgggttaaaggggtttaaattttgggtttaaactttccgttaaactttaaccgtttaacgttttcgaacccggtacgggttacgggggaacccgttaaccggggtaaccccg

SEQ ID NO: 352686 - DNA, 623 bp, Homo sapiens
  misc_feature: GZ8MTXP01AKEUA.4.1.A01.1.454.CMB.2.raw
  modified_base (235)..(235): a, c, t, g, unknown or other
  misc_feature (235)..(235): n is a, c, g, or t
tcagagcactgtagcacgaccggtgctcgatttagacgtctcatcaggggtcccaacaaccacatccctcctcagaagcccccagagcacaacacctcaccatggactggacctggaggatccttctttttggtggcagcagccacaggtgtccactcccaggtccaacttgtgcagtctgaggctgaggtgaagacgccgaggggcctcagtcaagtatttcctgtaaggcctntggatatacgttcattaactatgctatcctattgggcgcgccgacggccccccggaacaaacctggacgtggagtggggtgatcaatggtagaaacgtaggaaaaaacctaatattacaccgagcttcccgagggcaagaatgaacccatccgacccgggacaccactccgcgacgcgacaatctatcgtaggaactgacgcccgctagactatctaggcctaaggaccgtcgggactaggtttacttagttttcgtagggttgacgggaaggtaaggggaggggggtaaggtaggttggggtttaggaaggggttaactttggttacttcgatttaaccttagtttcgaccgtacggttgggggaacccgttaacggggtaaccccg

SEQ ID NO: 352687 - DNA, 580 bp, Homo sapiens
  misc_feature: GZ8MTXP01BLBK7.4.1.A01.1.454.CMB.2.raw
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (502)..(502): a, c, t, g, unknown or other
  misc_feature (502)..(502): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagtatttcctgtaacggcctctggatatacgttnattaactatgctatccattggngcgccacggcccccggaacaaacctgacgtggagtgggttgatcgaagtggtagaaactaggaaaaacctaaatattacaccgagcttaccccgagggtacagaatacgaaccatccgtcccgggacacgactcccgagacgccgacaatctactcgtaggaaactgacgcccgcgtagacactctcgcgacgtacgtcggactagttactatttcgtagtgacgtaggaggnggggaagtagttgggtagagggtattgttacttcgataattacgttgacctaggttcggggtccgaaggggtaacccc

SEQ ID NO: 352688 - DNA, 677 bp, Homo sapiens
  misc_feature: GZ8MTXP01DJ8PA.4.1.A01.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
  modified_base (362)..(362): a, c, t, g, unknown or other
  misc_feature (362)..(362): n is a, c, g, or t
  modified_base (451)..(451): a, c, t, g, unknown or other
  misc_feature (451)..(451): n is a, c, g, or t
tcagagcactgtagcacgaccggtgctcgatttagacgtctcatcaggggtcccaacaaccacatccctcctcagaacgcccccagagcacaacacctcaccatggactggacctggaggatccttctttttggtggcagcagccacaggtgtccactcccaggtccaacttgtgcagtctgaggctgaggtgaagcgccgaggggcctcagtcaagtntttcctgtaaggcctntggatatacgttnattaactatgctatcctagttgggcgcgccgacggaccccccgaanaaaaccgtgacgtggagtggggttgatcaagtggtaagaaactaggaaaaaacctaatacttcaacgngtccttcccgagggacagaatcgaacccatcccgacccgggacaccactcccgagacgccgacaattctatcgtagaacgtgacgcccnctagactatcgtcgacgtacggtaccgtcggacgtaagtttacttagttttcgaggttacgacgggtaaggacgggggaaggggggtaagtacgggttggggtttaagggaaagggggttttaatttacggttttaacttcccgttaaagtttaacccgtttaacggtttccgaaccccgtaccgggttaccgggggtaacccgttaacccgggggttaaaccccg

SEQ ID NO: 352689 - DNA, 707 bp, Homo sapiens
  misc_feature: GZ8MTXP01A9R4W.4.1.A01.1.454.CMB.2.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
  modified_base (546)..(546): a, c, t, g, unknown or other
  misc_feature (546)..(546): n is a, c, g, or t
tcagagcactgtagcacgaccggtgctcgatttagacgtctcatcaggggtcccaacaaccacatcccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttcctagtaaggcctntggatatacgttnattaactatgctatcctagttgggngccgaccacggaccccccggaacaaaccgtaggacgtggagtggggtgatcgaagtggtagaaacgtaaggaaaaacctaatacttacaaccgagtacgttaccccgaggggacagtaaactcgaaaaccctacgtcccggtaccccgggaacaacccgtacgtacccggacgacgtacccgactaatctactcgtacggaactggaccgtccgtcctagacctatccgtacgaccgaacggtaccgtcggacttaagttattcgtttccgngggttacgagggaaggtaggggaacgggggtaagtaaggttggggttagggaaagggtttaatttcgggtttaacgttcccgttaaagttttccctttaacgtttccggaacccggttacgggttaccgggggtaacccgttaaccgggggttaacccccg

SEQ ID NO: 352690 - DNA, 713 bp, Homo sapiens
  misc_feature: GZ8MTXP01CGOUW.4.1.A01.1.454.CMB.2.raw
  modified_base (135)..(135): a, c, t, g, unknown or other
  misc_feature (135)..(135): n is a, c, g, or t
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
tcagagcactgtagcacgaccggtgctcgatttagacgtctcatcaggggtcccaacaaccacatccctcctcagaacgcccccagagcacaacacctcaccatggactggacctggaggatccttctttttggnggcagcagccacaggtgtccactcccaggtccaacttgtgcagtctgaggctgaggtgaagacgccgaggggcctcagtcaagtatttccngtaacggcctgtggatatacgttntaattaactatgactatcctagttgggtcgccgccgaccggaccccccggaacaaaaccgtggacgtgggacgttggggtagatacgaagttaggtaacgaaaacgtaaggaaaaaaacctaattagttaccaaccggtagaccgtttaacccccgaaggggacaagtaacgtacgaaaccctacgtcccggtaccccggggaacaacctaccggtcccgaacggacgaccgacctaataccgtaagtccgtacggaaaccgtggaccgcccgtaccgtacgacctacgtcgtcggacaacggtaccttcgggactagttaacttatttcggtggtacgtagggaggtagggagggggaagtggttggggtaggttaacggggttatttacggttacttaccgaacttaacgttacgttaaccgaaccgtcgggttacggggaacccgttaacgggtaacccg

SEQ ID NO: 352691 - DNA, 713 bp, Homo sapiens
  misc_feature: GZ8MTXP01C1OTR.4.1.A01.1.454.CMB.2.raw
  modified_base (135)..(135): a, c, t, g, unknown or other
  misc_feature (135)..(135): n is a, c, g, or t
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (282)..(282): a, c, t, g, unknown or other
  misc_feature (282)..(282): n is a, c, g, or t
tcagagcactgtagcacgaccggtgctcgatttagacgtctcatcaggggtcccaacaaccacatcccctcctcagaagcccccagagcacaacacctcaccatggactggacctggaggatccttctttttggnggcagcagccacaggtgtccactcccaggtccaacttgtgcagtctgaggctgaggtgaagcgccgagggcctnagtcaagtntttcngtagcctntgatatacgtnattaactntnctatcagttggngcgccacggaccccgaanaaactgacgtgagtggtgatcgaagtggtagaaacgtaaggaaaaaccaagttactacgaccgagtccttacccgaggacaagaactcgaaacctacgtcccgtaccgggaacaaccgacgtccccggacgaccggacctacgtaactacgtacgtacgtacggaacgtacggtaccgcccgtaccgtacgaacctacgttaccgtacgaccggtaaccggtaccggtaccggtaacgtagtttaattaccgtttgtacggtggaaccggtaagggtaaggggaaggggtaagggtacggtttagggggttacggttaaaggggtttaaatttacggtttaacttccgttaaacgtttaaccgtttacgtttaaccggtaacccggtaccggggttacgggggtaaccccgaaaccggggtttaaccccgg

SEQ ID NO: 352692 - DNA, 635 bp, Homo sapiens
  misc_feature: GZ8MTXP01BOX4O.4.1.A01.1.454.CMB.2.raw
  modified_base (212)..(212): a, c, t, g, unknown or other
  misc_feature (212)..(212): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
tcagagcactgtagcacgaccggtgctcgatttagacgtctcatcaggggtcccaacaaccacatccctcctcagaacgcccccagagcacaacacctcaccatggactggacctggaggatccttctttttggtggcagcagccacaggtgtccactcccaggtccaacttgtgcagtctggaggctggaggtgaagcgccgaggggcctnagtcaagtatttcctgtaaggcctntggatatacgttnaattaactatgctatcagttgggncgccacgccccgaanaaacctgacgtggagtggggtagatacgaagtggtaagaaaacgtaaggaaaaaacctaagtacttaccgaacgacgtaccttacccgagggtacaagaactcgaaacccacgtccgtacccgggaacaccaacgtccgacgagccgactaaatcctaagtcgaggtaactcggacgtcccgcctaggactctacgtgaccgagtaccgtcggactagtattacgtttcgaggtcgtacggaggagggtaggggaaggtgttcgggtagaacgggttaattgttaacgttcaatttaacgtcgtttaacgaccgtacggttcggggaacccgttaacgggaacccg

SEQ ID NO: 352693 - DNA, 619 bp, Homo sapiens
  misc_feature: GZ8MTXP01D3AHH.4.1.A01.1.454.CMB.2.raw
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (497)..(497): a, c, t, g, unknown or other
  misc_feature (497)..(497): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagcgccgaggggcctcagtcaagtatttcctagtaacggcctgtggatatacgttnaattaactatgctatccattggncgcacggccccgaanaaacctgacgtgatgggtgatcaagtgtanaaacagaaaacatatcacganctaccaggcagaatcgaaaccatccgtacccgggaacaccgtagtccccggcgacgtacgactaaattcctaatcgttaggaaactcggaacgtcccgctagaacatctacgacgtacgtacgtcggactagttaattcgtttcgaggtgacggtaaggngggaaggggggaataggttcggggttaggaggggttaaatttcggtttacttccgttagttaaccttacgtttaaggaccccttagggacggggtaaccccgttaacgggggttaaaccccg

SEQ ID NO: 352694 - DNA, 602 bp, Homo sapiens
  misc_feature: GZ8MTXP01D0W9D.4.1.A01.1.454.CMB.2.raw
  modified_base (234)..(234): a, c, t, g, unknown or other
  misc_feature (234)..(234): n is a, c, g, or t
  modified_base (267)..(267): a, c, t, g, unknown or other
  misc_feature (267)..(267): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttcctgtaaggcctntgatatacgttcattaactatgctatcattggngcgccgacggcccccggaacaaaacctgacgtggagtgggttgatcaagtggtagaaacgtaggaaaaaaccaatattacaaccgagccttaccccgagggacaagaatcgaaacccatccgacccgggaacacacgtcccgcgagccgacaatctatcgtaggaactggacgccgcctgacctatctgcgaagtactccggactagtacttatttcgtagtgacggtagagggtggggaagtggttgggttggaacggggtatttggttaacttcccgttaattaacttaacgtttcgaccgtacggttcggggaaccgttaacgggtaacccg

SEQ ID NO: 352695 - DNA, 672 bp, Homo sapiens
  misc_feature: GZ8MTXP01EP0JK.4.1.A01.1.454.CMB.2.raw
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (354)..(354): a, c, t, g, unknown or other
  misc_feature (354)..(354): n is a, c, g, or t
  modified_base (388)..(388): a, c, t, g, unknown or other
  misc_feature (388)..(388): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttcctgtaaggcctctggatatacgttcattaactatgctatccagttgggngcgccacggaccccccggaanaaaacccgtgacgtggagtgggtgatcaagtggtagaaactaggaaaaacaatatacacganctcccgaggacagatgaaccatccgtcccggganacactccgacgagcgacaatctatcgtagaactagacgtcccgccagacactctgcgaagtaccgtcggactagttacttacgttttcgtaggtcgtacgggaaggtaaagggggaaggggggtaaagggttaagggtttggggggtttaagggaaagggggttaaaccgtttttaagggtttaactttaacccggttaatttaaacccgtttacgttttaacccggaaacccgtaacggggttaccgggggtaaccccggttaaacgggggtttaaccccccg

SEQ ID NO: 352696 - DNA, 537 bp, Homo sapiens
  misc_feature: GZ8MTXP01EZETZ.4.1.A01.1.454.CMB.2.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (508)..(508): a, c, t, g, unknown or other
  misc_feature (508)..(508): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttccngtaagcctntggatatacgttcattaactatgctatccattgggncgccaggcccccganaaacctgacgtgatgggttgatcaatggtagaaactaggaaaaaaccaatattcaccgagcttcccgagggcagaatgaaaccatccgtacccgggacacactccgcgagcgaccaatctatctggaactgacgccgctgacatctgcagactcggacagtntagtttcnggtgacgagaggaggggaagagttgggtgagggtacttgttacttcgattaacgtnttgaccctagttgggccaaggggtaaccc

SEQ ID NO: 352697 - DNA, 705 bp, Homo sapiens
  misc_feature: GZ8MTXP01A5UET.4.1.A01.1.454.CMB.2.raw
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagcgccgaggggcctcagtcaagtactttccgagtaacggccttgtggattatacgttcaattaactatgctatcctagttgggtgccgcccgacgggaccccccggaactaaaaccgtggaaccggtggaagttggggttgactacgaagtgggtagaaaacgtagggaaaaaaccctaaattacttacgaacgtagtccgttacccgagggacaaggaactcggaacccacgtccgtacccgggaacaccgacgtcccggcggggactacctaactcgtagtccgtaggaacctggaacgcccgtactcgactactcgtacgctaacggggtaccgttcggaccttaagttacttacgtttccgtgtacggtacggaagggtagggtacgggggtagtaaggttggggttaggtaagggttaagtttcggtaactttaccgttattacccgtttaatttccgaaccggttaccggtaggggttaccccgtaacgggttaaccccgttcggg

SEQ ID NO: 352698 - DNA, 694 bp, Homo sapiens
  misc_feature: GZ8MTXP01DMSDL.4.1.A01.1.454.CMB.2.raw
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (475)..(475): a, c, t, g, unknown or other
  misc_feature (475)..(475): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagcgccgaggggcctcagtcaagtntttccngtaaggcctntggatatacgttcattaactatgctatccagttgggncgcccgacggacccccgaanaaacctggacgtggatggggttagatcgaaagtggtagaaaactaggaaaaaaccaattattaccaccgagtccgttaccccgaggggacaaggaactcggaaacctacttcccgaccccgggaacacgtacgtcccgacgacgccgtactaattcctaatccgtaggaactgacgccaccgtanactgtctagacgtacgtaccgtcggactaagttacttagttcgtacggtcggtaagggtaaggggaaggggtaagggggtaaggttaaggtttgggggtaagggttaaacgggtttaagtttcgtttaaccgttccgttaaacgtttaacccgttaacggtttaacccgaaccggttaccggggttaccggggtaaccccggttaaccggggtaacccg

SEQ ID NO: 352699 - DNA, 621 bp, Homo sapiens
  misc_feature: GZ8MTXP01APXYA.4.1.A01.1.454.CMB.2.raw
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (535)..(535): a, c, t, g, unknown or other
  misc_feature (535)..(535): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagtntttccngtaaggcctntggatatacgttnattaactatgctatccagttgggncgccacggccccgaanaaaccngacgtggatgggtgatcgaagtggtagaaacgtaggaaaaaacctaagttacttacgaacgagtcttaccccgagggcaagaactcgaaaccctagtcccgtacccgggacacgacgtcccggacgacgccgactaactcgtagtccgtagggaacctcggacgtcccgaccttagaacctagtccgtagaccgacgtacgtcggacgtaagttacgttatttcgtggtcgagtagggagggnggggaagtggttgggttaggaggttattgttacttccagttaactacgttcgaaccgtggttcgggaaccgttaacgggtaacccg

SEQ ID NO: 352700 - DNA, 713 bp, Homo sapiens
  misc_feature: GZ8MTXP01B05TT.4.1.A01.1.454.CMB.2.raw
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
  modified_base (294)..(294): a, c, t, g, unknown or other
  misc_feature (294)..(294): n is a, c, g, or t
  modified_base (514)..(514): a, c, t, g, unknown or other
  misc_feature (514)..(514): n is a, c, g, or t
tcagagcactgtagcacgaccggtgctcgatttagacgtctcatcaggggtcccaacaaccacatccctcctcagaacgcccccagagcacaacacctcaccatggactggacctggaggatcctctttttggtggcagcagccacaggtgtccactcccaggtccaacttgtgcagtctgaggctgaggtgaagacgccgaggggcctnagtcaagtntttccngtaacgcctntggattatacgttcattaactatgctatccagttgggcncgccgacgggacccccgaanaaacctggacgtggagtggggttagatcgtaaagtggtaagaaaacgttaacggaaaaaaaccctaagttacttacccgaaccgagtaccttaccccggaaggggacaaggtaactcggaaaacccaagttcccggacccgggaacaaccgaaccgtcccggacgaacgcccgactaaacttctaacgtcgtacggaaacttcgaacggccctaccgtanacctcgtcgtacgacggtaacgtaccgtcgtactagttacttcgttcgtagggtacggaacgggtagggaggggtaagggggtaagttagggtttacggggtaaggttaagggtttaactttcgtttacgttaccgttaactttaaccgtacgttaacggaccgtacgggttaccggggtaacccgttaacgggtcccg

SEQ ID NO: 352701 - DNA, 712 bp, Homo sapiens
  misc_feature: GZ8MTXP01DBTKX.4.1.A01.1.454.CMB.2.raw
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
tcagagcactgtagcacgaccggtgctcgatttagacgtctcatcaggggtcccaacaaccacatccctcctcagaagcccccagagcacaacacctcaccatggactggacctggaggatccttctttttggtggcagcagccacaggtgtccactcccaggtccaacttgtgcagtctgaggctgaggtgaagcgccgaggggcctcagtcaagtatttcctgtaacggcctcgtggatatacgttcattaactatgctatcattggngcgcacggccccgaanaaacctgacgtggatggggtgatcgaatggtagaaacgtaggaaaaaaccaattattaccaacgagtccttaccgagggtacagaaatcgaaacccacgttccgacccgggaaccaacgactacccggacgacgaccgacaaacttccttaacgtcgttaacgggaaactcggaacgtcccgtacccgttgaaaccctattaccgttcggactaacgggtacccgtttacggggacctaaaggttgtttaacttttccgtaggtaggtacgggtaaagggtaaggggacggggggtaaagtaggtttagggggtttgggaaaggggtttaaaccttttggtttaaactttccccgttaaatttaacccgtttactttaacggaacccgtacgggttccggggtaacccgaacggggttaaaccccg

SEQ ID NO: 352702 - DNA, 793 bp, Homo sapiens
  misc_feature: GZ8MTXP01ARRTQ.4.1.A01.1.454.CMB.2.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtacttttccngtaacggcctcgtggatatacgttnaattaactatgctatccagttgggncgccacggcccccgaanaaacctgacgtggagtgggtgatcaagtggtagaaactaggaaaaaacctaattacttacgaaccgagtaccttacccgaggggacaaggaactcggaaaccctaagtcccggtaccccgggaaacaccgtacgtccccggacggaacggcccgtaactaaacgttcctaagttccggttaacgggaaaccttacgggacccggtccccgcccgttaggaaccctacgttacgttacggaacccgtaacgggtaacccgttcggggaacctttaaaggtttactttaaccgttttccggtaggtttacgggaccgggtaaaggggtaaagggggtaaggggggggtaaggttaacgggttagggggttacggttaaacggggggtttaaattttacggtttaacggtttacccttaaacgtttaacccgtttaacggtttaaccgaaccccgggtacggggttacccgggggtaacccgttaaccgggggttaacccccg

SEQ ID NO: 352703 - DNA, 566 bp, Homo sapiens
  misc_feature: GZ8MTXP01AMLM4.4.1.A01.1.454.CMB.2.raw
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttcctgtaaggcctctggattatacgttcattaactatgctatccattgggncgccaggccccganaaactgacgtggatgggtgatacaagtggtagaaactaggaaaaaccaatatcacgagcttccccagggnaagatgaaccatccgtacccgggacacnctccgcgagcgacaatcctatctagggaactgacgccgcctgaccatctgacgaagccgtcgggactacggttattactttcgtaggtcgtacggaggaggagggggtaagagttggggtagagggtactttggttacttcgattaacgtacttgaccaggttcggggcgaacggggtaaccc

SEQ ID NO: 352704 - DNA, 633 bp, Homo sapiens
  misc_feature: GZ8MTXP01AK141.4.1.A01.1.454.CMB.2.raw
  modified_base (133)..(133): a, c, t, g, unknown or other
  misc_feature (133)..(133): n is a, c, g, or t
  modified_base (234)..(234): a, c, t, g, unknown or other
  misc_feature (234)..(234): n is a, c, g, or t
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (442)..(442): a, c, t, g, unknown or other
  misc_feature (442)..(442): n is a, c, g, or t
  modified_base (472)..(472): a, c, t, g, unknown or other
  misc_feature (472)..(472): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggnggcagcagccacaggtgtccactcccaggttcaacttgtgcagtctgaggctgaggtgaagacgccgaggggcctcagtcaagtatttcctgtaaggcctntggatatacgttcattaactntgctatcattgggncgccacggccccgaacaaactgacgtggatgggtagatcaatggtagaaactaggaaaaacctaatattccaaccgagtcttaccccgaggggcaagtaatcggaaacccagttcccgtacccggggaacacacgtcccgcgagccgcaaactctatcgtggaactgacgccnctagacatctgacgagacgtcggatagttnttatttcgtggtcgacggtaaggaggggagggggtaacggtaggttgggggttaggaaacggggttaattttacgggtttacgtttccttaacgttaacctttacgtttaacggaaccccgtagggttaccgggggtaacccgttaaccggggtaaccccg

SEQ ID NO: 352705 - DNA, 647 bp, Homo sapiens
  misc_feature: GZ8MTXP01AIKP0.4.1.A01.1.454.CMB.2.raw
  modified_base (133)..(133): a, c, t, g, unknown or other
  misc_feature (133)..(133): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggnggcagcagccacaggtgtccactcccaggtccaacttgtgcagtctgaggctgaggtgaagacgccgaggggcctcgagtcaagtatttccngtaaggcctgtggatatacgttcaattaactntgctatccagttgggncgccacggccccgaacaaaccgtgacgtggagtggggtagatacaagtggaagtaaacgtaaggaaaaaacctaatacgttaccgaaccggtagtccgttaccccgaagggacaaggaatcgaaaccctacgtcccgtacccgggacacgtacgtccggcgacgcgactaatctagtcgtacggacgtcggacgcccgtacgtagacactcgtcgacgtagaccgttcggactagttacgttattcgtaggtcgtacggaggtagggagggggtaaggtaggttaggggtaggaaagggttaactttaggttacttcgttagttaaccgttacgttaacgacgtacggttcgggtaacccgaacggtaaccccg

SEQ ID NO: 352706 - DNA, 784 bp, Homo sapiens
  misc_feature: GZ8MTXP01BUFHF.4.1.A01.1.454.CMB.2.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
tcagagcactgtagcacgaccggtgctcgatttagacgtctcatcaggggtcccaacaaccacatccctcctcagaacgcccccagagcacaacacctcaccatggactggacctggaggatccttctttttggtggcagcagccacaggtgtccactcccaggtccaacttgtgcagtctgaggctgaggtgaagacgccgaggggcctcagtcaagtattttccngtaacggcctntggatatacgttcaattaactatgctatccattgggnccgccgacggccccgaanaaaccgtgacgtggagtggggtgatacaagtggtagaaactaaggaaaaaacctaatacttaccgaaccgtagacctttaccccgaggggtacaaggaactacgaaacccacgttcccggtacccccggggaacaccgtaccgtccccggacggacgccgacctaaagtccgttaaatccgttaacgggaaccttagggaaccggtcccctacccgttagaacccgtacgtttcgtaccggaccgtaacgggtacccgttaccggggaccttaaggtttaacctttagtttttccgtaggggttcgaacggggtaagggttaacggggaggggggtaaggtaagggtttgggggttaaagggttaaaccgggggtttaaatttttacggggtttaaccgttcccttaaaacgttttaacccgtttaacgtttcggaaacccccggtagggtttaccgggggaaccccgttaaacggggtttaacccccggg

SEQ ID NO: 352707 - DNA, 579 bp, Homo sapiens
  misc_feature: GZ8MTXP01EECFK.4.1.A01.1.454.CMB.2.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (486)..(486): a, c, t, g, unknown or other
  misc_feature (486)..(486): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcaggtcaagtatttcctgtaagcctntggatatacgttnattaactatgctatccattgggtgcgccacggcccccgaacaaaacctgacgtggatggggttgatcaatggtagaaactaggaaaaaccaatattacacgagcttcccgaggcagatcgaaccatccgtaccgggacacactccgcgagcgctaatctagtctaggaactgacgtccgcctagacatcgtcgacgtagcccgttggacctagtattagtttccgtgtgcgaggagggngggggaatggttcgggtaggaagggtatttggttattccaagttaaccttagtttcgaccgtaggcggggtaaccgttaacgggtaaccccgg

SEQ ID NO: 352708 - DNA, 644 bp, Homo sapiens
  misc_feature: GZ8MTXP01B7JK6.4.1.A01.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggncgccacggcccccgganaaaaccctggacgtggatggggttgatcaatggtagaaactagggaaaaaaccaatacttcaaccgagccttcccgaggggcaaggaatcgaacccatcccgtacccgggacaccgagtcccgcggagccgactaactctatccgtaggaaacctggacgcccgcctaggaccatctgaccgaggtaccgtccggactaaggtcttagtttcgtggttcgacggtaggtaagggagggggtaaggtagttgggggttaggaaggggttaaatttcgggtttaacttccgttaatttaacccgtttacgttcggaacccgtacgggttccgggggtaacccgaacgggggttaacccccg

SEQ ID NO: 352709 - DNA, 647 bp, Homo sapiens
  misc_feature: GZ8MTXP01CH6AR.4.1.A01.1.454.CMB.2.raw
  modified_base (303)..(303): a, c, t, g, unknown or other
  misc_feature (303)..(303): n is a, c, g, or t
  modified_base (443)..(443): a, c, t, g, unknown or other
  misc_feature (443)..(443): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttccgtagtaacggcctcgtggattatacgttcaatttaactatgcttatccgagttgggcgccgccgaccgggccccccgaanaaaccgtggacgtggagttggggtagatacgaagtggtagaaacgtagggaaaaaacccaagttacttaccgaccgagtccttaccccgaggggacaagaactcgaaacccatcccgtaccccgggacaccgagtcccgngacgccgacaatctaatcgtaggaactgaacgcccgctagacagtcgtgacgtacgacgtcggactagtcttagttcgaggtgacggtaggacgggagggggaagtgttggggttaggaagggttaatttcggttaacttccgagtttaaccgtacgtttcggaacccgtcgggttacggggaacccgttaaccgggtaacccg

SEQ ID NO: 352710 - DNA, 569 bp, Homo sapiens
  misc_feature: GZ8MTXP02IUQHE.4.1.A01.1.454.CMB.2.raw
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcaattaactatgctatccattgggtgcgccacggcccccgaacaaaacctgacgtggatggggttgatcaagtggtagaaaactaggaaaaaccaatatcacgagcttcccgaggcagaatgaccatcgtccgganacactccgngagcgacaatcatctggaactgacgccgctagacatctgacacgtactccggctaagtattacgtttctggtagcggaagaggaagggggagtagtgggttagaggggttaattggttaacttccaattaacgttacgtttacgaaccgtacgttcggggacccgtaacgggtaaccccg

SEQ ID NO: 352711 - DNA, 531 bp, Homo sapiens
  misc_feature: GZ8MTXP02JT2Z5.4.1.A01.1.454.CMB.2.raw
  modified_base (463)..(463): a, c, t, g, unknown or other
  misc_feature (463)..(463): n is a, c, g, or t
  modified_base (479)..(479): a, c, t, g, unknown or other
  misc_feature (479)..(479): n is a, c, g, or t
tcagagcactgtagcacgaccggtgctcgatttagacgtctcatcaggggtcccaacaaccacatccctcctcagaagcccccagagcacaacacctcaccatggactggacctggaggatcctcttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggtgatcaatggtgaaaactaggaaaaaccaatattacaccgagtcttacccgagggcagaatgaaccatccgtacccgggacaccgatcccggcgacgcgacaatctagtctaggaactgacgcccgtcctgacatctgcagctcggcagtattagtttcngtgcggagaggagggngagtggtagaggtattgtactcatctacttagactagtcggccagggtaccc

SEQ ID NO: 352712 - DNA, 510 bp, Homo sapiens
  misc_feature: GZ8MTXP02JUOX1.4.1.A01.1.454.CMB.2.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
tcagagcactgtagcacgaccggtgctcgatttagacgtctcatcaggggtcccaacaaccacatcctcctcagaagccccagagcacaacacctcaccatggactggacctggaggatcctcttttttggtggcagcagccacaggtgtccactccccaggtccaaacttgtgcagtctgaggctgagtgagacgccagggccncagtcaagntttccngtaaggcctctggntatacttcattaacntgcntccattggtgngccaggcccccggacaaaacctgactggatggttggancaatggtagaaactgggaaaaaccaaatattcnccgagcttccccagggcagaatgaccatctcccgggacacatccgngagcgcaatctatctgaactnagccgcctnacatctgcagactcgggcagtatatttctgtncgagnagggggagatggttgagggattgttatccataactctttgaccactggggccaggggtaccc

SEQ ID NO: 352713 - DNA, 526 bp, Homo sapiens
  misc_feature: GZ8MTXP02I5RUQ.4.1.A01.1.454.CMB.2.raw
  modified_base (267)..(267): a, c, t, g, unknown or other
  misc_feature (267)..(267): n is a, c, g, or t
  modified_base (423)..(423): a, c, t, g, unknown or other
  misc_feature (423)..(423): n is a, c, g, or t
  modified_base (450)..(450): a, c, t, g, unknown or other
  misc_feature (450)..(450): n is a, c, g, or t
tcagagcactgtagcacgaccggtgctcgatttagacgtctcatcaggggtcccaacaaccacatccctcctcagaagccccagagcacaacacctcaccatggactggacctggaggatcctcttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtncgccaggcccccgacaaaacctgacgtggatggggttggatcaatggtagaaactgggaaaaaccaatatacaccgagcttcccagggcagaatgaccatctcccgggacacactccgcgagcgcaatctatctaggaactgacgtccgcctgacntactgacagactcggcagtactattcngtgcgagagaggggagatgggttgagggtattcgtattccgatctacttgacctagtcggggaccagggtaacccg

SEQ ID NO: 352714 - DNA, 564 bp, Homo sapiens
  misc_feature: GZ8MTXP02HG0WJ.4.1.A01.1.454.CMB.2.raw
  modified_base (350)..(350): a, c, t, g, unknown or other
  misc_feature (350)..(350): n is a, c, g, or t
  modified_base (467)..(467): a, c, t, g, unknown or other
  misc_feature (467)..(467): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttcctgtaaggcctctggatatacgttcattaactatgctatccattgggtgcgccacggcccccgaacaaaacctgacgtggagtgggttgatcaagtggtagaaactaggaaaaaccaatatacacganctcccaggcagatgaccatccgtcccgggacaccactcccgcgacgcgacaatcctatccgaggaacctgacgccgcctgacctatcctgacagactcgggactagtattagtttcngtacgacgaggaggaggggagtagttgggtagaagggttattcgttaactccattaacgttactttacgacctaggtcggggacctaacggtacccg

SEQ ID NO: 352715 - DNA, 583 bp, Homo sapiens
  misc_feature: GZ8MTXP02JLR3L.4.1.A01.1.454.CMB.2.raw
  modified_base (327)..(327): a, c, t, g, unknown or other
  misc_feature (327)..(327): n is a, c, g, or t
  modified_base (372)..(372): a, c, t, g, unknown or other
  misc_feature (372)..(372): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagtatttcctgtaacggcctcgtggattatacgttcattaactatgctatccagttgggtgcgccacggcccccgaacaaaaccgtgacgtggatggggttgatcaagtggtanaaactaggaaaaacaatactacacgatctcccgaggcagatgacntccgccggacacatccgcgagcgacatctatcgtagaactgacgccgctagaccatctgacacgacgtcggactagttattacgtttctggtacgcggaagagggaggggagtaggttgggtagaaggggttactttggttaacttaccgtaagttaacgttaaccgtttacgaacccgtacggtacggggaccgtacggggtaacccccg

SEQ ID NO: 352716 - DNA, 530 bp, Homo sapiens
  misc_feature: GZ8MTXP02JJE1X.4.1.A01.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (447)..(447): a, c, t, g, unknown or other
  misc_feature (447)..(447): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagattcctgtaaggcctctggatatacgttcattaactatgctatccattgggtncgccaggcccccgganaaacctgacgtggatgggttgatcaatggtagaaactaggaaaaaccaatatacacgagctcccaggcagaatcgaccatccgtacccgggacacgactccgcgagcgacaatctatctgaactgacgccgctgacatctgcagctcggactagtatattcgngtgcgagaggagggaggtatgggttagagggtaacttgtatcgattaacgtacgttacgactacgtcgggaccacggtacccg

SEQ ID NO: 352717 - DNA, 606 bp, Homo sapiens
  misc_feature: GZ8MTXP02F22ZS.4.1.A01.1.454.CMB.2.raw
  modified_base (297)..(297): a, c, t, g, unknown or other
  misc_feature (297)..(297): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtattttcctagtaaggcctcgtggatattacgttcaattaactatgctatccagttgggtgccgccgacggcccccggaanaaaaccgtgacgtggatggggttgatcaagtggtagaaacgtaggaaaaaccaattactacaccgagtccttaccccgagggcaagaatgaccatccgcccgggacacactccgagacgcgacaatctatctaggaactgacgccnctgacatcngcagactcggactagtacttattcgtgtcgacgagagggaagggggtagtaggtttgggtacgggaaagggttaactttggtttaacttccgtaagttaacttaacgtttacggaaccctacggttacgggggaccctaacggggttaaccccg

SEQ ID NO: 352718 - DNA, 564 bp, Homo sapiens
  misc_feature: GZ8MTXP02HRA69.4.1.A01.1.454.CMB.2.raw
  modified_base (248)..(248): a, c, t, g, unknown or other
  misc_feature (248)..(248): n is a, c, g, or t
  modified_base (269)..(269): a, c, t, g, unknown or other
  misc_feature (269)..(269): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctggaggtgaagacgccgaggggcctcagtcaagtatttcctgtaaggcctctggatatacgttnattaactatgctatcatggtncgccacggcccccgaacaaacctgacgtggatggggttgatcaatggtagaaactaggaaaaacaatatcacgagctccgaggcagaatgaccatccgtcccggacacactccgacgagccgacaatctatcgtggaaactggacgcccgtactgacatctagcagactcgggactaagttattatttcgtggtcgacggaggaggagggggagtaggttggtagaggggttaatttcggttaatccgtaataacgttacgtttacgaccgtagtcggggacctacggggtaccc

SEQ ID NO: 352719 - DNA, 596 bp, Homo sapiens
  misc_feature: GZ8MTXP02G973G.4.1.A01.1.454.CMB.2.raw
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagatttcctgtaaggcctctggatatacgttcattaactatgctatccattgggtgcgccacggacccccggacaaaaccgtgacgtggatgggttggatcaatggtagaaaactaggaaaaaccaatactacaccgagtctacccgaggggacaaggaactggaaccacgtccgtcccggggaacaccgacgtcccgacgacgaccgactaatacctaatcgtaggtaactgacgcccgctgacatctcggacacgactcggctagtattatttcgtgtgacggagaggagggggaggagttgggtagtaaggggtaactttgttacgtctaataacgttacgtttacgaccgacggttacggggaccacggggtaacccg

SEQ ID NO: 352720 - DNA, 577 bp, Homo sapiens
  misc_feature: GZ8MTXP02GXW34.4.1.A01.1.454.CMB.2.raw
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccacggcccccgacaaacctgacgtggatggggttgatcaagtggtagaaactaggaaaaaccaatatacacgagcttcccgaggcagaatgaccatccgtcccgggacacactccgacgagccgacaatctatctaggaactgacgccgactgacatctgcagacgtcggactagtacttatttcgtagtcgacgaggaggaagggggtaggtagtggggttagaggggttaaatttggttaactccgtaattaacgttacgtttacgaccgtacggttacggggacccgtaacggggtaacccg

SEQ ID NO: 352721 - DNA, 672 bp, Homo sapiens
  misc_feature: GZ8MTXP02JFHUN.4.1.A01.1.454.CMB.2.raw
tcagagcactgtagcacgaccggtgctcgatttagacgtctcatcaggggtcccaacaaccacatccctcctcagaagccccagagcacaacacctcaccatggactggacctggaggatcctctttttggtggcagcagccacaggtgtccactcccaggtccaacttgtgcagtctgaggctgaggtgaagacgccgaggggcctcagtcaagatttcctgtaaggcctctggatatacgttcattaactatgctatccagttgggtgcgccacggcccccgacaaaacctgacgtggatgggttgatcgaatggtagaaacgtagaaaaaccaatatacacgagctacccgaggcagatcgaccatccgtacccgggacacacgtccgacgagcgacaatctatcgaggaactgacgcccgcctagactatctcgacgacgtaccgtcgggactaagttatttatttcgtggtacggaccggtaagggaggggtaagggggtaggtaggtttagggggttaacgggtaaagggggtttaaactttttgggtttaaactttacccccggtaaaagttttaaccccgtttaaacggtttttacgggaaacccccgtttaacgggggtttaccggggggtaaccccgtaaaacgggggtttaaaccccccgg

SEQ ID NO: 352722 - DNA, 550 bp, Homo sapiens
  misc_feature: GZ8MTXP02G0LGX.4.1.A01.1.454.CMB.2.raw
tcagagcactgtagcacgaccggtgctcgatttagacgtctcatcaggggtcccaacaaccacatccctcctcagaagcccccagagcacaacacctcaccatggactggacctggaggatccttctttttggtggcagcagccacaggtgtccactcccaggtccaacttgtgcagtctgaggctgaggtgaagacgccaggggcctcagtcaagatttcctgtaaggcctctggatatacgttcattaactatgctatccagttgggtgcgccacggcccccggaacaaaacctgacgtggagtgggttggatcaatggtagaaaactaggaaaaacctaaatacttacaacgagtctaccgaggcaagaatgaccatccgtcccgggaacacacgtcccgacgacgccgacaaatctatcgtaggaactgacgcccgctgactatctgacagctcggactagtacttattcgtgtcgcgagaggaggggagagtggtagaggtaattgtactcataacgtcttacgacagtcggaccgaggtaaccg

SEQ ID NO: 352723 - DNA, 567 bp, Homo sapiens
  misc_feature: GZ8MTXP02G3WYE.4.1.A01.1.454.CMB.2.raw
  modified_base (454)..(454): a, c, t, g, unknown or other
  misc_feature (454)..(454): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccacggcccccggacaaacctgacgtggatgggttgatcaatggtagaaactaggaaaaaccaatactacaccgagctccccgaggcagatcgaccatcgtccgggacacatccgcgagcgcaatctatctaggaactgacgccgcctgaccatctgacagacgtcggctagtacttatttcngtcgacgaggaggagggggagtaggttgggttaggaggggtaatttcggttaacttcctaattaacgttacttttacggaccgtacgtcgggggaacctacggggtaaccccg

SEQ ID NO: 352724 - DNA, 635 bp, Homo sapiens
  misc_feature: GZ8MTXP02IRKLF.4.1.A01.1.454.CMB.2.raw
  modified_base (475)..(475): a, c, t, g, unknown or other
  misc_feature (475)..(475): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccagttgggtgcgccacggcccccggaacaaaacctgacgtggagtgggttgatcaagtggtagaaaactaggaaaaacctaaatatacaccgagcttacccgagggacagaatgaccatcctccgggacacactccgcgacgcgacaaatctatcgtaggaaactggacgccgcctagacatcgtgacacgtactcggctaagtattactttcgngtgacggaaggaggaagggggtagtaagttggggtttacggaaaggggtttaaattttcggtttaactttaaccccgaaagttttaaccgtttaacgttttacggaaaaccccgtaacgggtttaccgggggaaccccgtaaaacgggggttaacccccg

SEQ ID NO: 352725 - DNA, 569 bp, Homo sapiens
  misc_feature: GZ8MTXP02GBHSS.4.1.A01.1.454.CMB.2.raw
  modified_base (269)..(269): a, c, t, g, unknown or other
  misc_feature (269)..(269): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (412)..(412): a, c, t, g, unknown or other
  misc_feature (412)..(412): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtncgccacggcccccggacaaaacctgacgtggatgggttggatcaatggtagaaactaggaaaaaccaatattacacgagcttcccaggcagatgacatctccggganacanccgcgagcgcaatctatctggaactgacgccncgtgaacatctgcagactcgggactagtaacttgtttctggtcgacgaaggtaggagggggaacggtagttggggttacggaaggggttaactttggttaacttccgtaattaacgttactttcggaccctacgtcggggaccacgggtaaaccccg

SEQ ID NO: 352726 - DNA, 534 bp, Homo sapiens
  misc_feature: GZ8MTXP02JNQVR.4.1.A01.1.454.CMB.2.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
tcagagcactgtagcacgaccggtgctcgatttagacgtctcatcaggggtcccaacaaccacatccctcctcagaagcccccagagcacaacacctcaccatggactggacctggaggatcctcttttggtggcagcagccacaggtgtccactcccaggtccaacttgtgcagtctgagctgaggtgaagacgccaggggcctcagtcaagatttcctgtaaggcctctggatatacgttcattaactatgctatccattgggncgccaggcccccganaaacctgacgtggatgggttgatcatggtanaaactggaaaaaccaatattcacgagctacccgaggcagatgacntcnccggancatccgnagcgcaatctanctggaactgacgcncctgacatcngcagtcncggcagtattatttcgngtcgagaggagggaggggtagtaggttgggtaggtaggttactttagtactacgagttaacgttacgttacgaccgtaggtaccgggaccacggggtaccc

SEQ ID NO: 352727 - DNA, 623 bp, Homo sapiens
  misc_feature: GZ8MTXP02GPUA8.4.1.A01.1.454.CMB.2.raw
  modified_base (281)..(281): a, c, t, g, unknown or other
  misc_feature (281)..(281): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
  modified_base (514)..(514): a, c, t, g, unknown or other
  misc_feature (514)..(514): n is a, c, g, or t
tcagagcactgtagcacgaccggtgctcgatttagacgtctcatcaggggtcccaacaaccacatccctcctcagaagcccccagagcacaacacctcaccatggactggacctggaggatccttctttttggtggcagcagccacaggtgtccactcccaggtccaacttgtgcagtctgaggctggaggtgaagacgccgaggggcctcagtcaagtatttcctggtaacggcctgtaggatattacgttacaattaactatgctatcctagttgggcncgaccgacggccccgaacaaaaccgtgacggtggagtggggttgatcgaagtggtaagaaaacgtacggaaaaaacctaattactacgaaccgagtccttacccgagggacaaggatcgaacctcgtccggtacccggganaccgactccggngacgcgaacatactagtcgtaggaactgacgcccgctagacagtcagccaggactcggatagtattagtttcgtgtacgnggaggtagggagggtaggtaggtgggttaggaaacgggtatttacgttacgttctaacgttaacttacgttacggacctacgggtacgggacccgtaacgggtaccccg

SEQ ID NO: 352728 - DNA, 613 bp, Homo sapiens
  misc_feature: GZ8MTXP02HHDM4.4.1.A01.1.454.CMB.2.raw
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (477)..(477): a, c, t, g, unknown or other
  misc_feature (477)..(477): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttcctagtaaggcctctggatatacgttnattaactatgctatcattgggtncgccacggccccganaaaccgtgacgtggatgggtgatcaatggtanaaacgtaggaaaaaccaatactacacgagtctacccgaggcagaatcgaaccatccgtacccgggaacacacgtccgacgacgcgacatctactcgaggaactgacgcccgactagacctatctcgacacgtacgtccggactaagttattactttcgnggtacggacggtaaggaggggaagggggtaggtaggtttggggtacgggaaagggtttaactttaggttaacttaccgtaattaaccgttacgtttacgaacccgtacggtcggggaccgtaaaccgggttacccg

SEQ ID NO: 352729 - DNA, 541 bp, Homo sapiens
  misc_feature: GZ8MTXP02FGZVP.4.1.A01.1.454.CMB.2.raw
  modified_base (207)..(207): a, c, t, g, unknown or other
  misc_feature (207)..(207): n is a, c, g, or t
  modified_base (285)..(285): a, c, t, g, unknown or other
  misc_feature (285)..(285): n is a, c, g, or t
  modified_base (413)..(413): a, c, t, g, unknown or other
  misc_feature (413)..(413): n is a, c, g, or t
  modified_base (428)..(429): a, c, t, g, unknown or other
  misc_feature (428)..(429): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgagctgaggtgaagacgccaggggcctnagtcaagatttcctgtaaggcctctggatatacgttcattaactatgctatccattgggtgcgccacggcccccgganaaaaccctgacgtggatgggttgatcaatggtagaaaactggaaaaaccaatatcacgagctcccgagggcagaatgaccatcctcccgggacacactccgcgagcgcaatctaatctaggaactgancccgactgacatccnncagacgtcgacatattattctgtgagagaggagggaggtagtaggtaggtaggtagttacgttactactactaacgttacgttacgtacgacgtacggaccggacggtaccg

SEQ ID NO: 352730 - DNA, 691 bp, Homo sapiens
  misc_feature: GZ8MTXP02JCSCV.4.1.A01.1.454.CMB.2.raw
  modified_base (552)..(552): a, c, t, g, unknown or other
  misc_feature (552)..(552): n is a, c, g, or t
tcagagcactgtagcacgaccggtgctcgatttagacgtctcatcaggggtcccaacaaccacatccctcctcagaacgcccccagagcacaacacctcaccatggactggacctggaggatccttctttttggtggcagcagccacaggtgtccactcccaggtccaacttgtgcagtctgaggctgaggtgaagcgccgaggggcctcagtcaagtactttccgtaggtaacggcctcgtagggattactacgttctaattaactatgctatcctagttggggtcgccgccgaccggaccccccggaacaaaaccgtggaccgtggagtggggtttagatacgaagtgggtaacgaaaacgtaaggaaaaaacctaattactaccgaaccgtagtccttacccgaagggacaagaatcgaaccacgtccgtacccgggacaccgacgtccgacgacgacgacaactctaatcgtagaacctggaccgcccgtactagacctagttccgcgacgtaacgaccgttcgggaactaagtttaacttgtttcgnggttcggacggaaggaggggaagggggtacgtaggttggggtaacggaaaggggttacttttgggttaaacttcgtaattaaccgtttcgtttaacgacccgtaacggttccgggggaacccgaacgggttaaccccgg

SEQ ID NO: 352731 - DNA, 779 bp, Homo sapiens
  misc_feature: GZ8MTXP02IGUFS.4.1.A01.1.454.CMB.2.raw
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctggaggtgaagacgccgaggggcctcgagtcaaagtatttccgtagtaacggcctgtggattatacgttcaattaactatgctatccagttgggtncgccacggacccccganaaaaccgtgacggtggagtggggttgatacgaagtggtagaaaactaaggaaaaacctaatactacgaaccgtagtccttacccgaggacaagaactcgaacctacgtcccgtacccgggaacaccgtaccgtcccggacgacgaccggaactaaacgtaccgttacgtaccgtacgggtaaaccgtcggaaccgtccccggtaccgtacggaacctacgttaccgtacgtaccgacggtaaccgtccgggtaacgtaacgtttaacgtttaacgttttccggtaggttacgggtacggtaaggggtaaacgggggaaagggggtaagggtagggtttagggggttaaacgggtaaagggggtttaaatttttacgggtttaaactttaacccgtaaacgtttaaaccggtttacgtttaaccggtaacccggttaacggggtacccgggggtacccggtaacccggggtttaaacccccgg

SEQ ID NO: 352732 - DNA, 569 bp, Homo sapiens
  misc_feature: GZ8MTXP02GELI5.4.1.A01.1.454.CMB.2.raw
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttnattaactatgctatccattgggtncgccacggcccccganaaacctgacgtggatgggtgatcaagtggtagaaactggaaaaaccaatattacaccgagctcccgagggcagaatgaccatccgtacccggganacanccgngagcgcaatctatcgtaggaactgacgccgcctagaccagtcctgactacgaccgtcgggactagtacttactttcgagtggacgaaggagggagggggatcgtgggttaggaagggtaactttggttactccgtaattaacgttacgttgaacccgtgtcggggactaacgggtaccccg

SEQ ID NO: 352733 - DNA, 573 bp, Homo sapiens
  misc_feature: GZ8MTXP02I9A6U.4.1.A01.1.454.CMB.2.raw
  modified_base (247)..(247): a, c, t, g, unknown or other
  misc_feature (247)..(247): n is a, c, g, or t
  modified_base (271)..(271): a, c, t, g, unknown or other
  misc_feature (271)..(271): n is a, c, g, or t
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
  modified_base (432)..(432): a, c, t, g, unknown or other
  misc_feature (432)..(432): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctggaggtgaaagcgccaggggcctcagtcaagtatttccagtaaggcctctggatatacgttnattaactatgctatccattgggcncgccgacggcccccgaaaaacctgacgtggatgggtgatcaatgganaaactagaaaacatatcacganctaccgaggcagatcgaccatccgtaccgggaacgctccggacgacgcgacaatctagtcgtaggaaaccgtgaccgccgtccgtagacctntccgtggaccacgaacgtcccgggataaagttacttagtttccgagtgcgaagaggggtagggaggtattggggtacgaggtaatttggtaactccaagttaacctagttaccgaccgtagtcgggaccgtacgggtaccc

SEQ ID NO: 352734 - DNA, 652 bp, Homo sapiens
  misc_feature: GZ8MTXP02H2S1M.4.1.A01.1.454.CMB.2.raw
  modified_base (303)..(303): a, c, t, g, unknown or other
  misc_feature (303)..(303): n is a, c, g, or t
  modified_base (444)..(444): a, c, t, g, unknown or other
  misc_feature (444)..(444): n is a, c, g, or t
tcagagcactgtagcacgaccggtgctcgatttagacgtctcatcaggggtcccaacaaccacatccctcctcagaagcccccagagcacaacacctcaccatggactggacctggaggatccttcttttggtggcagcagccacaggtgtccactcccaggtccaacttgtgcagtctgaggctggaggtgaagacgccgaggggcctcagtcaagtatttcctgtaacggccttcgtaggattatacgttctaattaactatgctatccagttgggtcgccgccgacggaccccccggaanaaaacccgtggaccggtggagtggggttagatacgaaagtggtaagaaaacgtaggaaaaacctaatataccaacgtagccttacccgagggacaagaactcgaaccatccggtacccgggaacaccgacgtacccgcganccgacaatctatcgtaggaactggacgcccgtactagactatcgacgacgacgtacgtcggactagttattactttcggtgtaggacggaaggagggaagggggtgtaggttggggttaacggaagggttactttaggttaccttaccgtaatttaaccgttacgttacgacccgtacggttaccggggacccgtaacggggtacccg

SEQ ID NO: 352735 - DNA, 568 bp, Homo sapiens
  misc_feature: GZ8MTXP02G0E2G.4.1.A01.1.454.CMB.2.raw
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (319)..(319): a, c, t, g, unknown or other
  misc_feature (319)..(319): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (432)..(432): a, c, t, g, unknown or other
  misc_feature (432)..(432): n is a, c, g, or t
  modified_base (457)..(457): a, c, t, g, unknown or other
  misc_feature (457)..(457): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttccngtaaggcctctggatatacgttcattaactatgctatccattgggtncgccacggcccccgaacaaaactgacgtggatgggttgatcgaatggtanaaaactaggaaaaaccaatactacacgagctccagggcaagatgaccatccgacccgganacatccgcgancgacatctatctagaactgacgcccgcctgaccattcgcgancgtaacgtcgggactaggtaatttnttcgtgacggaggagggagggaggggtacggtagttgggtagaagggttacttacgtacttacaattaacgttacgttacgaccgtacggtacggaccgtaacggtacccg

SEQ ID NO: 352736 - DNA, 611 bp, Homo sapiens
  misc_feature: GZ8MTXP02IP2ZN.4.1.A01.1.454.CMB.2.raw
  modified_base (270)..(270): a, c, t, g, unknown or other
  misc_feature (270)..(270): n is a, c, g, or t
  modified_base (345)..(345): a, c, t, g, unknown or other
  misc_feature (345)..(345): n is a, c, g, or t
  modified_base (397)..(397): a, c, t, g, unknown or other
  misc_feature (397)..(397): n is a, c, g, or t
  modified_base (475)..(475): a, c, t, g, unknown or other
  misc_feature (475)..(475): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagtatttcctgtaaggcctctggatatacgttcattaactatgctatccattgggtncgcacggcccccgacaaacctgacgtggatgggttgatcaagtggtagaaactaggaaaaaccaatatacacgancttccaggcagaatgaccatccgtaccgggaacacacgtccgacgagccganatctaatcgtaggaaacctgaccgccgacctgacctagtcctggccagtacgtcgggactaacgttattacgtttcgnggtcgacggaaggagggaagggggaacgtaggttggggttacgaaaggggttaatttcggttaacttacctaagttaaccgtttacgttacggaccccgtaaggtccgggggtaaccctaacggggttaacccccg

SEQ ID NO: 352737 - DNA, 623 bp, Homo sapiens
  misc_feature: GZ8MTXP02GBF9F.4.1.A01.1.454.CMB.2.raw
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
  modified_base (498)..(498): a, c, t, g, unknown or other
  misc_feature (498)..(498): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagatttcctgtaaggcctctggatatacgttcattaactatgctatccagttgggtncgccgacggcccccgaanaaaccgtgacgtggatgggtgatcaatggtagaaactaggaaaaaccaattatacgacgagtcttacccgagggcaagaatcgaaccctagtccgtacccgggaacaccgacgtcccgacgacgccgacaaatcctagtctaggaactgacgccgacctgactactcgtagaccaggaccgtcgggactaaggttacttagttttccgnggttacggacggtaaggaggggaagggggtagtaggttgggttaggaaaggttatttacggttaacttccgtaattaaccgttacgtttacgaccgtacggtacggggaccgtacgggtaacccg

SEQ ID NO: 352738 - DNA, 638 bp, Homo sapiens
  misc_feature: GZ8MTXP02HJKHM.4.1.A01.1.454.CMB.2.raw
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
tcagagcactgtagcacgaccggtgctcgatttagacgtctcatcaggggtcccaacaaccacatccctcctcagaacgcccccagagcacaacacctcaccatggactggacctggaggatccttctttttggtggcagcagccacaggtgtccactcccaggtccaacttgtgcagtctgaggctggaggtgaagcgccgaggggcctcagtcaagtatttccgtagtaacggtcctcgtggattatacgttctaattaactatgctatccagttgggngccgccgacggcccccgaanaaaccgtgacgtggagtgggttgatcgaagtggtagaaaacgtaaggaaaaaccaatactacaaccgtagtcttaccccgaggacaagtaaatcgaaccactcccggtacccggaacaccacgtccggacgacgcactaatctatcgagaactgacgccgtactgactagtctacgacacgtctacgggactagttattactttgtcgtggacggaggtaggggagggggtaaggtggttagggtaaggaagggttaagtttcgtttaactacgttaaagttaacgttacgtttacggaaccgtacgggtaccggggaacccgtaaccgggtacccg

SEQ ID NO: 352739 - DNA, 592 bp, Homo sapiens
  misc_feature: GZ8MTXP02HVDZX.4.1.A01.1.454.CMB.2.raw
tcagagcactgtagcacgaccggtgctcgatttagacgtctcatcaggggtcccaacaaccacatccctcctcagaagcccccagagcacaacacctcaccatggactggacctggaggatcctcttttttggtggcagcagccacaggtgtccactcccaggtccaacttgtgcagtctgaggctgaggtgaagacgccgaggggcctcagtcaagtatttcctgtaaggcctctggatatacgttcattaactatgctatccattgggtgcgccacggcccccggaacaaaacctgacgtggagtggggttgatcgaagtggtagaaaacgtaggaaaaaacctaaagtattacaaccgagcttccccgagggacagaatgaaccagtccgtacccgggaacacactccgcgagccgacaaatctatcgtaggaactgacgcccgctgacatcgtgacagaccgtcggactagttattagtttctgtgcgaggagggagggggtagtaggttgggtaggtaagggttatttaggtttactacctattaacgttacttacgacctacggtcgggaccgtacgggtaacccg

SEQ ID NO: 352740 - DNA, 538 bp, Homo sapiens
  misc_feature: GZ8MTXP02FN3W5.4.1.A01.1.454.CMB.2.raw
  modified_base (268)..(268): a, c, t, g, unknown or other
  misc_feature (268)..(268): n is a, c, g, or t
  modified_base (385)..(385): a, c, t, g, unknown or other
  misc_feature (385)..(385): n is a, c, g, or t
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatcattgggtncgcaggcccccgacaaaacctgacgtggatgggtggatcaatggtgaaaactggaaaaaccaatatacacgagcttcccagggcagaatgaccatccgtcccgggacacactcccgngaagcgacaatctatctaggaactganccgctgaccatcngcagactcgggacagtattatttcgagtgcgagagggaggggagagtggtaggaaggtacttgttactccgaataacgttactttcgacctacgtcggggaccaggtaacccg

SEQ ID NO: 352741 - DNA, 600 bp, Homo sapiens
  misc_feature: GZ8MTXP02I0G1L.4.1.A01.1.454.CMB.2.raw
tcagagcactgtagcacgaccggtgctcgatttagacgtctcatcaggggtcccaacaaccacatcccctcctcagaagcccccagagcacaacacctcaccatggactggacctggaggatcctctttttggtggcagcagccacaggtgtccactccccaggtccaacttgtgcagtctgaggctgaggtgaagacgccaggggcctcagtcaagtatttccttaaggcctctggatatacgttcattaactatgctatcctattggtgcgccgacggcccccggaacaaaaccgtgacgtggagtgggtggatcaatggtagaaactaggaaaaacctaatattacacgagctcgacggcagaatgaccactccgtcccgggacacactccgcgacgcgcaatctatcgtaggaactgacgcccgctagacatctgaccagtacgtcggactacgtatttactttcgtggtgacggaggaagggagggggaggtagtaggggtaggtacggggtaatttggttaacttactattaacttaacgtttacggaacccgtacggttacggggacccggtaacggggaaccccgtttacgg

SEQ ID NO: 352742 - DNA, 570 bp, Homo sapiens
  misc_feature: GZ8MTXP02HWNXT.4.1.A01.1.454.CMB.2.raw
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (318)..(318): a, c, t, g, unknown or other
  misc_feature (318)..(318): n is a, c, g, or t
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagatttccngtaaggcctntggatatacgttcattaactatgctatccattgggncgccacggcccccganaaacctgacgtggatgggtgatcgaagtggtanaaactagaaaaaccatatcacgagcctccgaggcagaatcgaccatccgtcccgganacactccgcgagcacaatctatcgtagaacgtgacgcgcctgacatcgngcagaccgtggacctagttaatcttcgtgtacggacgaaggagggtaggggaggtaagtttggggtacggaaggggttaatttcggttaaacttccgtaataacgtttacttacgacccgtaaggtccgggactacggggtaaccc

SEQ ID NO: 352743 - DNA, 692 bp, Homo sapiens
  misc_feature: GZ8MTXP02JQS02.4.1.A01.1.454.CMB.2.raw
  modified_base (247)..(247): a, c, t, g, unknown or other
  misc_feature (247)..(247): n is a, c, g, or t
  modified_base (273)..(273): a, c, t, g, unknown or other
  misc_feature (273)..(273): n is a, c, g, or t
  modified_base (401)..(401): a, c, t, g, unknown or other
  misc_feature (401)..(401): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagatttcctgtaacggcctctggatatacgttntattaactatgctatccagttgggtncgccacggccccgaacaaacctgacgtggatggggtgatcgaagtggtagaaacgtaggaaaaacctaaatacttacaccgagtacgtaccccgagggcagaactcgaaccacgtccgtcccgggaanaccgactccggcgacgcgactaattctagtcgttaggaaccgtagaccggcccgtacccgtagtacctacgttccgtcggaaccgacggtacccgtaccgggtacttaacggttaactttacgttttaccggtggttcgggtacggaagggtaaggggaggggggtaacgtagggtttaggggttaacggaaaggggttaacttttaggtttacttaccgtaaacgttcgtttaaaccgttacggtaacccgtacgggtttaccgggggaccctaacgggggtaacccccg

SEQ ID NO: 352744 - DNA, 696 bp, Homo sapiens
  misc_feature: GZ8MTXP02I81E7.4.1.A01.1.454.CMB.2.raw
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (555)..(555): a, c, t, g, unknown or other
  misc_feature (555)..(555): n is a, c, g, or t
tcagagcactgtagcacgaccggtgctcgatttagacgtctcatcaggggtcccaacaaccacatccctcctcagaagcccccagagcacaacacctcaccatggactggacctggaggatcctcttttggtggcagcagccacaggtgtccactccccaggtcccaacttgtgcagtctgaggctgaggtgaagacgccgaggggcctcagtcaagtcttttcccgtaggtaacggcccttcgtggtaattacgttacgttacaatttaactatgcttatcctagttgggtnccgccgacggccccccggtaanaaaaccgtgacgtggacgtggggttggatacaagtggtagaaaactaacggaaaaacctattaacgttaccaaccgtagtcctttacccgaggggtacagtaaactcggaacccacgtcccgtacccgggaacaccgacgtcccgacgaacggcccgtactaaagttccctaaattccgtaaggtaacctagaccgtcccgaccgtagaccagttccgtgaccacggtcgtacccgggtntaagttattagtttctacggagtaggaaggaggggtaggggagttagtagggttgggaaacggttagtttagttacttaccgtaattaacggtttaccttacgaccgtaccggttacgggacccgtaacgggtttacccgg

SEQ ID NO: 352745 - DNA, 597 bp, Homo sapiens
  misc_feature: GZ8MTXP02H1637.4.1.A01.1.454.CMB.2.raw
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
tcagagcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccgaggggcctcagtcaagtatttcctgtaaggcctctggatatacgttcattaactatgctatccagtgggtncgcacggccccgaanaaacctgacgtggatgggttgatcaagtggtagaaacgtagaaaaacctaatataccgacgagctaccgaggcaagatcgaccactccgtacccggacaccgacgtcccgacgagaccgactaaagtctaacgtcgtaggaacctggaccgcccgactcgactacttcgagcgaagtccgtacggatacgttatttcgttcgtggtcgacggaggagggaggggtagtaggttgggtaggtaagggtatttacgtacttacctagtttaacgtcgttaacgaccgtcggtacgggccgtaacgggtacccg

SEQ ID NO: 352746 - DNA, 702 bp, Homo sapiens
  misc_feature: GZ8MTXP02H9GAK.4.1.A01.1.454.CMB.2.raw
  modified_base (235)..(235): a, c, t, g, unknown or other
  misc_feature (235)..(235): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (502)..(502): a, c, t, g, unknown or other
  misc_feature (502)..(502): n is a, c, g, or t
tcagagcactgtagcacgaccggtgctcgatttagacgtctcatcagggtcccaacaaccacatccctcctcagaagcccccagagcacaacacctcaccatggactggacctggaggatcctctttttggtggcagcagccacaggtgtccactcccaggtccaacttgtgcagtctgaggctgagtgaagacgccgagggcctacagtacaagtatttccgtagtaaggcctntggatatacgttactattaatatgctatcattggtgccgccgaccggacccccgaanaaaccgtggacgtggtagtgggttacgngtacgaagtacggtaagaaaacgtaacggaaaaaaacctaataacgttacgaaccgtacgtccgttacccgaacgggacgaagtaaactacgacccgtagttaccccgacccgggaaacaccgtaccgtaccgacggacgtacccgactaacgtacttataacgtaggaactcggggacccnccgaccgtacgtactacgtacgacgacgacgtaccgtacgtacgttaagttacgtttacgtttggacggtacggagggtaagggagggggtaaggggtacggtagggttaggggtagggtaaggttacgttttacgttacgtaccgttaagttaacgttacgtacggaaccggtcggtaccggtaccggtaacggcccgg

SEQ ID NO: 352747 - DNA, 501 bp, Homo sapiens
  misc_feature: GZ8MTXP01DV7M7.22.73.G07.1.454.CMB.2.raw
  modified_base (194)..(194): a, c, t, g, unknown or other
  misc_feature (194)..(194): n is a, c, g, or t
  modified_base (291)..(291): a, c, t, g, unknown or other
  misc_feature (291)..(291): n is a, c, g, or t
  modified_base (354)..(354): a, c, t, g, unknown or other
  misc_feature (354)..(354): n is a, c, g, or t
tcagacatacgcgtcacgaccggtgctcgatttagctctacgctcaggggaggaactgctcagttaggacccagacggaaccatggaagcccagcgcagcttctcttcctcctgctactctggctcccagataccactggagaaatagtgatgacgcagtctccagccaccctgtctgtgtctccgaggggaanagccacctctcctgcagggccagtcagagtgttagcaacaacttagtctggtaccagcagagacctggccaggctcccaggctcctcatctatggtncttctaccagggccatgggtactcccccgcaggttcagtgccccaggtgggtctgggacaagngttcactcacaccatcagcagcctgcagtctgaagtattttgctactttattactgtctaggctaatataatgtactggttctcgatcaccttcggccaagggcacgacttggagaattaaacgacttgtggctgcacatcttgttc

SEQ ID NO: 352748 - DNA, 490 bp, Homo sapiens
  misc_feature: GZ8MTXP01CG05F.22.73.G07.1.454.CMB.2.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (355)..(355): a, c, t, g, unknown or other
  misc_feature (355)..(355): n is a, c, g, or t
  modified_base (392)..(392): a, c, t, g, unknown or other
  misc_feature (392)..(392): n is a, c, g, or t
  modified_base (477)..(477): a, c, t, g, unknown or other
  misc_feature (477)..(477): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagtctggtaccagcagagacctggccaggctcccaggctcctcatctatggtncttctaccagggccactggtactccccgcaggttcagtgccccaggtggtctgggacaagngttcactctcaccatcagcagcctgcagtctgaagtntttgctactttattactgtcagctaatataatgactggttctcgatcacttcgcaagggcacgcttggagtattaacgcttgtgntgcacatcttgtc

SEQ ID NO: 352749 - DNA, 523 bp, Homo sapiens
  misc_feature: GZ8MTXP01C59G4.22.73.G07.1.454.CMB.2.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (264)..(264): a, c, t, g, unknown or other
  misc_feature (264)..(264): n is a, c, g, or t
  modified_base (286)..(286): a, c, t, g, unknown or other
  misc_feature (286)..(286): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgatgcagtctccagccaccctgtctgtgtctccgaggggaaanagccaccctntcctgcagggccagtcagagtgttagcaaacacttagtctggtaccagcagagaccnggccaggctcccaggcctcctnatctatggtgcctttcaccgagggcccacgtggactccccgcaggttcagtcgcctaggtggtctgggaacagtgttcactctcaccatcagcagcctgcagtcagtaagtatttgcttactttattactgtcagtacaatataatgactggttctcgtatcctacgtggaaccaagggacacgacgtaggaagttaacgttaaacgactgtacggctcgcttactaagttcgttcg

SEQ ID NO: 352750 - DNA, 500 bp, Homo sapiens
  misc_feature: GZ8MTXP01C59O3.22.73.G07.1.454.CMB.2.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (484)..(484): a, c, t, g, unknown or other
  misc_feature (484)..(484): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccagggggaaangccaccctctcctgcagggccagtcagagtgttagcaacaacttagtctggtaccagcagagacctggccaggctcccaggctcctcatctatggtncttctaccagggccactgggtacncccccgcaggttcagtgccccaggtgggtctggggacaagngttcactctcaccatcagcagcctgcagtctgaagtattttgctactttattactgtcaggcaatataatgactggttctcgatcaccttcggccaagggcacgacttggagattaaacgcttgnggctgcacatcttgtc

SEQ ID NO: 352751 - DNA, 508 bp, Homo sapiens
  misc_feature: GZ8MTXP01CGUH7.22.73.G07.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctctcctgcagggccagtcagagtgttagcaacaacttagctggtaccagcagagacctggccaggctcccaggctcctnatctatggtncttcaccgagggccatggtactccccgctaggttcagtcgccccaggtgggtctggggacaaggtagttcactctcaccatcagcagctgcagtcngagtntttgctactttatactgtcagctaatataatgtacttggttctcgatcaccttcggcctaagggcacgacgttggtaagtattaaacgcttgtggctgcaccttatcttgttcc

SEQ ID NO: 352752 - DNA, 559 bp, Homo sapiens
  misc_feature: GZ8MTXP01EUITU.22.73.G07.1.454.CMB.2.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaaacaacttagtctgggtaccagcagagacctggccaggctcccaggcctcctnatctatggtncttctaccagggccacgtgggtactccccgctaggttcagtgccccaggtggtctgggacagagttcactctcaccatcagcagctgcagtctagtaagtattttgctactttattactgtcaggtactaatataatgtacttggttctacgtatcctaccgttccggaccgaaacggggtacaacggtacgttagggaagtaacgtttaaaacggaacgttggtaagggctaacggacctaccttacttccgttcgttcc

SEQ ID NO: 352753 - DNA, 542 bp, Homo sapiens
  misc_feature: GZ8MTXP01A6IKF.22.73.G07.1.454.CMB.2.raw
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
  modified_base (534)..(534): a, c, t, g, unknown or other
  misc_feature (534)..(534): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccacctctcctgcagggccagtcagagtgttagcaaanacttagtctggtaccaggcagagacctggccaggcctcccgaggcctcctcatctagtggtcnctttcaccgngggccactgggtactcccccgnaggttcagtcgccccgaggtgggtctggggacaaggtattcactcacaccatcagcagcctgcagtctagaagtatttgactactttatactgtacaggtataaatatagtgtaccttggttcaccgtatccgtaccgttcggaccgaagggccacggacttggaagtaagttaaaccgagttgaaggtctgccaccgttntcgttgtc

SEQ ID NO: 352754 - DNA, 515 bp, Homo sapiens
  misc_feature: GZ8MTXP01BZGL3.22.73.G07.1.454.CMB.2.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
  modified_base (492)..(492): a, c, t, g, unknown or other
  misc_feature (492)..(492): n is a, c, g, or t
  modified_base (507)..(507): a, c, t, g, unknown or other
  misc_feature (507)..(507): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccaggggaangcccaccctctcctgcagggccagtcagagtgttagcaactaacttagtctgggtaccagcagagacctggcccaggcctcccaggcctcctcatctatggtcncttcaccgagggcctacgtggtactccccgcaggttcagtcgcccaggtgggctgggacaaggcgttcactctcaccatccagcagcctgcagtctagaagttattttgacttatttatactgtcaggctaaattatatgacttgttctcgatccacttcggccaagggcacgacttggagtaattaaacgnttggtgctgcacttntcgttgtc

SEQ ID NO: 352755 - DNA, 548 bp, Homo sapiens
  misc_feature: GZ8MTXP01C1HF0.22.73.G07.1.454.CMB.2.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (371)..(371): a, c, t, g, unknown or other
  misc_feature (371)..(371): n is a, c, g, or t
  modified_base (399)..(399): a, c, t, g, unknown or other
  misc_feature (399)..(399): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccacctgtctgtgtctccgaaggggaaancgccaccctctcctgcagggccagtcagtattgtancaactaacttagtctggtaccagcagagacctggccaggctcccgaggcctcctnatctagtggtncttcaccgagggccagtggtactccccgctaggttcagtcgccccaggtgggtctgggacagattcactcncacatcagcagctgcagtctagaagttnttttgacttatttattacttagtacaggtactaaattactaatgtacttggttctacgtatcctaccgttcggaccaaacgggacacgtacgttaggaagtaagttaaaacgcgttggtcggctcgacctacttacttcgttgttaacc

SEQ ID NO: 352756 - DNA, 503 bp, Homo sapiens
  misc_feature: GZ8MTXP01BO25O.22.73.G07.1.454.CMB.2.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttagcaacaacttagtctggtaccagcagagacctggccaggctcccaggctcctcatctatggtncttctaccgagggccactggtactccccgcaggttcagtcgccccaggtggtctgggacaagngttcactctcaccatcagcagctgcagtctgaagtattttgctactttattactgtcaggctaatataatgacttggttctcgtatcacttcggcctaagggcacgacttggagtattaaacgacttggtgctgcaccatcttgtcc

SEQ ID NO: 352757 - DNA, 611 bp, Homo sapiens
  misc_feature: GZ8MTXP01BCOLE.22.73.G07.1.454.CMB.2.raw
  modified_base (198)..(198): a, c, t, g, unknown or other
  misc_feature (198)..(198): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccacctctcctgcagggccagtcagagtgttagcaacacttagtctgggtaccagcagagacctggccaggcctcccgaggcctcctcatctagtggtctccttctaccgagggtccctacgtcgggtacctcccccggctaggttcaggtcgccccgtagggtgggtcgtggggacaaggtacgttcacgttcctaccgaccctatccgaagccacgcctgctagtctagtaagttattttgacttactttattactgtacaggtactaaattataagtgtacgttggttctacgtatcccgtaccgttccggaccgtaaaggggccaacggtacgttagggaaacgtaaacgtttaaaacggacgttgggtcggctaacggacctaccgttacttccgttgtttaaccc

SEQ ID NO: 352758 - DNA, 562 bp, Homo sapiens
  misc_feature: GZ8MTXP01A1I6D.22.73.G07.1.454.CMB.2.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcaacaacttagctggtaccagcagagactggccaggctcccaggctcctnatctatggtncttctaccgagggccacgtggtactcccccgctaggttcagtcgcccaggtgggtctggggacagtacgttcactctcaccatcagcacgcctgcagtctagaagtattttcgacttactttatactgtcaggctaattataatgaacttggttctacggtactcctacccgttacggcccgtaaaggggaccacggtaaccgttagggaaagtaacgtttaaaaccgacgttaggttgggaccttgccaaccttactccgttgtttaacc

SEQ ID NO: 352759 - DNA, 545 bp, Homo sapiens
  misc_feature: GZ8MTXP01BEJJI.22.73.G07.1.454.CMB.2.raw
  modified_base (198)..(198): a, c, t, g, unknown or other
  misc_feature (198)..(198): n is a, c, g, or t
  modified_base (300)..(300): a, c, t, g, unknown or other
  misc_feature (300)..(300): n is a, c, g, or t
  modified_base (408)..(408): a, c, t, g, unknown or other
  misc_feature (408)..(408): n is a, c, g, or t
tcagacatacgcgtcacgaccggtgctcgatttagctctacgctcagggggaggaactgctcagttaggaccaagacggaaccatggaagccccagcgcagcttctcttcctcctgctactctggctcccagataccactggagaaatagtgatgacgcagtctccagccaccctgtctgtgtctccgaaggggaaangcccaccctctcctgcagggccagtcagagtgttagcaaactaacttagtctggtaccagcagagacctggccaggcctcccaggcctcctcatctatggtncttcaccgagggccctacgtggtactccccgctaggttcagtcgccccaggtgggtctggggacaagtcgttcactctcaccatcagcagcctgctagtctagaagtnttttgcttactttattactgttacaggtactaaattataatgtacttggttctacgtatcctaccttcggaccgaagggacacggacttggaataagttaaacgacttggtggctcggccacttacttcttcgttcc

SEQ ID NO: 352760 - DNA, 582 bp, Homo sapiens
  misc_feature: GZ8MTXP01CIZLU.22.73.G07.1.454.CMB.2.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (311)..(311): a, c, t, g, unknown or other
  misc_feature (311)..(311): n is a, c, g, or t
tcagacatacgcgtcacgaccggtgctcgatttagctctacgctcagggggaggaactgctcagttaggacccagacggaaccatggaagcccagcgcagcttctcttcctcctgctactctggctccagataccactggagaaatagtgatgacgcagtctccagcccaccctgtctgtgtctccgaggggaaangccacctctcctgcagggccagtcagagtgtagcaacaacttagctggtaccagcagagacctggccaggctccaggctcctnatctatggtncttcaccagggccagtggtacnccccggctaggttcagtcgccctaggtgggtctggggacaagagttcactctcaccatcagcagctgcagtcgtagaagttattttcgacttatttacttacgtgtctaagggtactaaattataaagtgaactttggttctacgtactaccgtacccgttcgggaaccgtaaagggtacaaccgggtacgttacggggtaaataaacgtttaaaaccggaccgtttgggaacggtactcggacctaacgttcttaaccgttgtttaaccc

SEQ ID NO: 352761 - DNA, 491 bp, Homo sapiens
  misc_feature: GZ8MTXP01AQ3YQ.22.73.G07.1.454.CMB.2.raw
  modified_base (195)..(195): a, c, t, g, unknown or other
  misc_feature (195)..(195): n is a, c, g, or t
  modified_base (291)..(291): a, c, t, g, unknown or other
  misc_feature (291)..(291): n is a, c, g, or t
tcagacatacgcgtcacgaccggtgctcgatttagctctacgctcaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagattgtagcaacaacttagtctggtaccagcagagacctggccaggctcccaggctcctcatctatggtncttctaccagggccatggtactccccgcaggttcagtgccccaggtgggtctggggacagagttcactctcaccatcagcagcctgcagtctgaagtattttgctactttattactgtcaggctaatataatgactgttctgatcacttcggccaagggcacgacttggagattaaacgattgtggctgcacatcttgtc

SEQ ID NO: 352762 - DNA, 530 bp, Homo sapiens
  misc_feature: GZ8MTXP01CY6RT.22.73.G07.1.454.CMB.2.raw
  modified_base (196)..(196): a, c, t, g, unknown or other
  misc_feature (196)..(196): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (387)..(387): a, c, t, g, unknown or other
  misc_feature (387)..(387): n is a, c, g, or t
  modified_base (471)..(471): a, c, t, g, unknown or other
  misc_feature (471)..(471): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangccaccctctcctgcagggccagtcagagtgttagcaaacacttgtctggtaccagcagagacctggcaggctccagctccncatctatggtncttctaccaggccatggtacnccccgcaggttcagtgccccgaggtgggtctggggacagtagttcactctcaccatcagcagctgcagtctagagtntttgcttatttattactgtacagacaattataatgacgttggttctcgattccaccgttcggcccgaaaggggtcacggtacgngggtaaacgagtttaaaacgacgttgtaagggctcggctaccttattccttcggtttcc

SEQ ID NO: 352763 - DNA, 579 bp, Homo sapiens
  misc_feature: GZ8MTXP01BGDIB.22.73.G07.1.454.CMB.2.raw
  modified_base (198)..(198): a, c, t, g, unknown or other
  misc_feature (198)..(198): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagtagtgttagcaaactaacttagtctggtaccagcagagacctggccaggctcccaggctcctnatctatggtncttcaccgagggccacgtggtactcccccgctaggttcaggtcgccccgtagggtggggtactgggggaactaagggtacgtttcacttcctaccacccatccgagccacgcctgctagtcgtagtaaagttattttgacttactttattactgtacaggactaattataatgtacttggttctcgtactcctaccgttcggaccgtaagggacacggtaacgttagggaagtaacgttaaacgacgttaggtcggactcgcaccttacttcttcgttcc

SEQ ID NO: 352764 - DNA, 574 bp, Homo sapiens
  misc_feature: GZ8MTXP01DPVMO.22.73.G07.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (289)..(289): a, c, t, g, unknown or other
  misc_feature (289)..(289): n is a, c, g, or t
  modified_base (397)..(397): a, c, t, g, unknown or other
  misc_feature (397)..(397): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctntcctgcagggccagtcagagtgttagcaacaacttagtctggtaccagcagagactggcaggctccagctctcatctatggtncttctaccgagggccacgtggtactccccgctaggttcagtgccccaggtgggtctgggacaagagttcactctcaccatcagcagcctgcagtctagaagtattttnctaacttttataacgttatacaagtaactaaattaagtaatagtacgttcggttactacgtactccgtacccgtaccggaaccgtaaagggaccgacggtaacggttagggtaaacgtaaacgttaaaaccggttacgttggtaacggtacgtcgactaccttacttcgttcgttcg

SEQ ID NO: 352765 - DNA, 580 bp, Homo sapiens
  misc_feature: GZ8MTXP01DQABZ.22.73.G07.1.454.CMB.2.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaangcccacctctcctgcagggccagtcagagtgttagcaactacttagtctggtaccagcagagacctggccaggctcccaggcctcctnatctatggtncttcaccgagggccacgtcgggtactcccccgntaggttcaggtcgcccccgaggtgggtctgggggaaccaagggtacgtttccaacttcctacaacccctatccaggccacgccctgcagttctagtaagttattttgacttaactttatactgtctaggactaaattataatgtacgttggttctacgtactcctacccgttcgggacctaagggaccacggtacgttagggaaagtaacttaaaacgcgttaggtggctcgcaccttattccttgttcc

SEQ ID NO: 352766 - DNA, 584 bp, Homo sapiens
  misc_feature: GZ8MTXP01BRZ0K.22.73.G07.1.454.CMB.2.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccaccctctcctgcagggccagtcagagtgttagcaactaacttgtctgggtaccagcagagacctggccaggcctcccgaggcctcctcattctagtgggtnccttcgtaccgagggccacgtgggtactcccccgctaggttcaggtcgcccctaggtgggtctggggacaggacgttcactctcaccatcagcagcctgcagtctaggtaacgttattttgcttaactttattactgtaccaggtactaaattataagtcgtacgttggttctacgtactcctaccgttccggcccgtaaaggggcacggtacgttagggtaaacgtaacgttaaaaccggattcggtcggactcggaccaccgttattccgttcgttcc

SEQ ID NO: 352767 - DNA, 573 bp, Homo sapiens
  misc_feature: GZ8MTXP01A6ABF.22.73.G07.1.454.CMB.2.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcaacacttagctggtaccagcagagacctggccaggctcccgaggctcctnatctagtggtgcttctaccgagggccctacgtgggtactccccgctaggttcagtcgcccaggtgggtctggggacaagacgttcactcncaccatcagcagctgcagtctagtaagtnttttacgcttatttattactgtcaggctaatataatgacttggttctacgtactcctaccgttcgggaccaaaggggaccacggtacgttagggtaaacgtaacgtttaaaacggcgttagggtcgggtaccttaacggacctaaccgttacgtttccgttcggtttaaccc

SEQ ID NO: 352768 - DNA, 572 bp, Homo sapiens
  misc_feature: GZ8MTXP01BDIGJ.22.73.G07.1.454.CMB.2.raw
  modified_base (198)..(198): a, c, t, g, unknown or other
  misc_feature (198)..(198): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (553)..(553): a, c, t, g, unknown or other
  misc_feature (553)..(553): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgcagggccagtcagagtgttagcaactaacttagtctggtaccagcagagacctggccaggcctcccaggcctcctnatctatggtcncttctaccgagggccctacgtcgggtactcccccggctagggttccaggtcgccccgtaggtggggtctagggggacaaggtagtttccacgtcctacacctatccgaagccacgctgcgagttctagtaatattttcgacttactttatactgtacaggtactaatataatgtagttgttctcgtactcctaccgttcggaccgaaacggggcacggtacgttaggaacgtaattaaacgacttggtaacggntcgctaccatcttcgttcc

SEQ ID NO: 352769 - DNA, 533 bp, Homo sapiens
  misc_feature: GZ8MTXP01DEYK9.22.73.G07.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (422)..(422): a, c, t, g, unknown or other
  misc_feature (422)..(422): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgtagcaactaacttagtctggtaccagcagagacctggccaggctcccaggctccncatctatggtncttcacagggccatggtactcccccgcaggttcagtcgccccaggtgggtctggggacaagagttcactctacacatcagcagcctgcagtctgaagtacttttgactactttatactgtacaggtanaaattataaatgtacttggttctacgattcgaccgttcggcccaaagggcacggtaacttgggaaacgtaattaaaaccgcgttaggtggactgaccaccatccttgttcc

SEQ ID NO: 352770 - DNA, 518 bp, Homo sapiens
  misc_feature: GZ8MTXP01B4RGE.22.73.G07.1.454.CMB.2.raw
  modified_base (198)..(198): a, c, t, g, unknown or other
  misc_feature (198)..(198): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (320)..(320): a, c, t, g, unknown or other
  misc_feature (320)..(320): n is a, c, g, or t
  modified_base (446)..(446): a, c, t, g, unknown or other
  misc_feature (446)..(446): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaangccaccctctcctgcagggccagtcagagtgttagcaacacttagctggtaccagcagagacctggccaggctccaggctcnatcatggtncttctacgagggccacgtggtactcccccgntaggttcagtcgccccaggtgggtctgggacaagtagttcactctcacctatcgagcagctgcagtctagaagttatttgctactttatactgtacaggtactaatataatgactggttctacgtntccaccttcggactaagggacagacgttaggaaagtaacttaaacgcttgtggctgaccacatcgttgttcc

SEQ ID NO: 352771 - DNA, 587 bp, Homo sapiens
  misc_feature: GZ8MTXP01AWQAW.22.73.G07.1.454.CMB.2.raw
  modified_base (199)..(199): a, c, t, g, unknown or other
  misc_feature (199)..(199): n is a, c, g, or t
  modified_base (301)..(301): a, c, t, g, unknown or other
  misc_feature (301)..(301): n is a, c, g, or t
tcagacatacgcgtcacgaccggtgctcgatttagctctacgctcaggggggaggaactgctcagttaggacccagacggaaccatggaagccccagcgcagcttctcttcctcctgctactctgactcccagataccactggagaaatagtgatgacgcagtctccagcccaccctgtctgtgtctccgaggggaaangcccaccctctcctgcagggccagtcagagtgttagcaacaacttagtctggtaccagcagagacctggccaggcctcccgaggcctcctcatctagtggtncttctaccgagggcccagtggtacctcccccgctaggttcagtgcccctaggtgggtctggggacaaggtacgttcacgtctaccaccatcagccagcctgctagtctagtaacgtattttcgacttaactttacttactgtactaggactaattataatgtacgttggttactcgtactccgtaccgttccggaccgaaacggggacaaccggtacgttagggaaacgtaacgttaaacgacgttggtaacgggtctcggactaccgttacttcttcgtttaacc

SEQ ID NO: 352772 - DNA, 586 bp, Homo sapiens
  misc_feature: GZ8MTXP01A8XS6.22.73.G07.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (330)..(330): a, c, t, g, unknown or other
  misc_feature (330)..(330): n is a, c, g, or t
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcaactaacttagtctgggtaccagcagagacctggccaggctccaggcctctnatctagtcggtnctttcaccgagggcctacgtgggtactcccccgntaggttcaggtcgccccaggtgggtctggggacaagtacgttcactctacaccntcagcagcctgcagtctgaaagtttntttgacttactttactacgtgtacaagtactaaattactaagttgtacgttcggttactacgtactcccgtaccggttaccgggaaccgtaaacgggtacgaacggtacggttaggtaaacgttaacgttaaacggcgttaggtcggtctaacgacctacttacttccgttcgttc

SEQ ID NO: 352773 - DNA, 541 bp, Homo sapiens
  misc_feature: GZ8MTXP01EZJAW.22.73.G07.1.454.CMB.2.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (514)..(514): a, c, t, g, unknown or other
  misc_feature (514)..(514): n is a, c, g, or t
  modified_base (523)..(523): a, c, t, g, unknown or other
  misc_feature (523)..(523): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaaggggaaanagcccaccctntcctgcagggccagtcagagtgttagcaacactttagtctggtaccagcagagacctggccaggcctcccaggcctcctnatctatggtncttcaccgagggccacgtggtactcccccgcaggttcagtgccccaggtgggtctggggacagagttcactcncacctntcagcncgtcctgctagtctagtaagtatttcgacttactttagttacgtgtacagtactaaatattaatgtacgttgttcacgtactcctaccgtcggaaccgaagggacacgacgttaggaagtaacttaaacgngttggtcgntcgccacttatcgttgtc

SEQ ID NO: 352774 - DNA, 598 bp, Homo sapiens
  misc_feature: GZ8MTXP01EC88N.22.73.G07.1.454.CMB.2.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcgagggccagtcagagtgttagcaactaattgctggtaaccngcagacgacctggccaggcctccgaggcctcctcatctagtggtcgtccttcgtaccgagggccctacgtcgggtacctcccccggactaggttcagtcgaccccgtagggtgggtctaggggacctaagtacgttccactcctacacatcagcacgcctgctgtctagtaagttatttgacttactttatactagtacaggtactaaatataatgtacgttggttactacgtactccgtaccgttccggaccgtaaagggaccaacggtacgttaggtaaacgtaacttaaaaccggagttcggtcggtctaacggacctacgttacttaaccgttcgttcc

SEQ ID NO: 352775 - DNA, 556 bp, Homo sapiens
  misc_feature: GZ8MTXP01AWJIR.22.73.G07.1.454.CMB.2.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (329)..(329): a, c, t, g, unknown or other
  misc_feature (329)..(329): n is a, c, g, or t
  modified_base (409)..(409): a, c, t, g, unknown or other
  misc_feature (409)..(409): n is a, c, g, or t
tcagacatacgcgtcacgaccggtgctcgatttagctctacgctcagggggaggaactgctcagttaggaccaagacggaaccatggaagccccagcgcagcttctcttcctcctgctactctggctcccagataccactggagaaatagtgatgacgcagtctccagcccacctgtctgtgtctccgaggggaaangcccaccctctcctgcagggccagtcagagtgtagcaactacttagctggtaccagcaggagacctggccaggcctcccgaggcctccncatctagtggtncttcaccgagggccagtgggtactcccccgntagggttcagtcgccccgaggtggggtctggggacaaggtacttcactctacacatcagcagcctgcagtctagtaagtnttttcgcttaactttattactgttcaggtactaaattactaagtcgtacgttggttctacgtactccgtaccgttcggaccgaagggacacggtacgttggaacgtaagttaaaccgagttggtcgctcgacacttatcgttgttcc

SEQ ID NO: 352776 - DNA, 730 bp, Homo sapiens
  misc_feature: GZ8MTXP01AXIAG.22.73.G07.1.454.CMB.2.raw
  modified_base (199)..(199): a, c, t, g, unknown or other
  misc_feature (199)..(199): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctaccgaggggaaancgcccaccctctcctgcgagggccagtcagtagtgttagacaaactacttagtctagggtaaccagcagacgacctggcccaggcctcccgaggcctctcatctagtggtctcttaccgaccgagggacctacgtcggtacctcccccggactacgggtttcacggtcgccccgtagggtcgggtcgtgggacctaagggtactttccactctaccgacctatcgagccacgtcctgactacggttacgttagtaaacggtttctttttacggtacctttaactttttactttaacgtcggttaactaacgggtaacttaaagttaaattaaacgttacgtaacgtttccggtttacgttaccgttaccttaccccggttaacccgtttaccgggaacccgggtaaaagggtacccgttaacggtaaacggttacgggtaaaacggttaaaaccgtttaaaaccggacggtttacgggaacggtccttaacggtacccaaaccgttactttccgtttccggtttaaccccg

SEQ ID NO: 352777 - DNA, 591 bp, Homo sapiens
  misc_feature: GZ8MTXP01DJ5LX.22.73.G07.1.454.CMB.2.raw
  modified_base (197)..(197): a, c, t, g, unknown or other
  misc_feature (197)..(197): n is a, c, g, or t
  modified_base (446)..(446): a, c, t, g, unknown or other
  misc_feature (446)..(446): n is a, c, g, or t
  modified_base (560)..(560): a, c, t, g, unknown or other
  misc_feature (560)..(560): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaaactaacttagtctggtaccagcagagacctggccaggcctcccgaggcctcctcatctagtcggtgtccttccgtaccgacggggccctacgtcgggtacctccccccggcgtaggttcagttcgcccccgtaggtcggggtctgggggaactaaggtacgttcacgttcctacacccatcagccacgccgtgcgagttctagtaaagtnttttgacttactttatactgtacagtactaaattataagtgtacgttggttctacgtatccgtaccgtcggaccgaaagggacacggtacgttaggaaagtaacttaaaacggngttggcggtctgcctacgttatcttcgttcc

SEQ ID NO: 352778 - DNA, 612 bp, Homo sapiens
  misc_feature: GZ8MTXP01AQ3PL.22.73.G07.1.454.CMB.2.raw
  modified_base (198)..(198): a, c, t, g, unknown or other
  misc_feature (198)..(198): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaancgccaccctctcctgcagggccagtcagagtgttagcaaactaacttagtctgggtaccagcagacgacctggccaggcctccgaggcctcctcatctagtggtcgcttcaccgagggtcctacgtcgggtacctcccccgctaggttcaggtcgccccgtaggtgggtccgtggggacaaggacgtttccactctacacctatcgagcagctgcagtctagtaagttattttcgacttactttacttactgttaccaggtactaaagttataacgtgtacgttggttactacgtactccgtaaccgttccggacggtaaacgggacaacggtaccgttagggtaaacgtaacgttaaaaccggcgttagggtcgtaccgttcgacctaccgttacttccgtttcgttaacccg

SEQ ID NO: 352779 - DNA, 593 bp, Homo sapiens
  misc_feature: GZ8MTXP01BBAB6.22.73.G07.1.454.CMB.2.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (326)..(326): a, c, t, g, unknown or other
  misc_feature (326)..(326): n is a, c, g, or t
  modified_base (406)..(406): a, c, t, g, unknown or other
  misc_feature (406)..(406): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccacctctcctgcagggccagtcagattgtagcaacaacttgctggtaccagcagagacctggccaggcctccgaggcctccncatctatggtnccttcaccgagggcccagtggtactcccccggntaggttcagtcgccccaggttcgggtctggggacaaggagttcactctcaccatcagcagcctgctagtctagtaagttnttttcgcttactttattactgtacagggtactaaatataagtgtaacgttgggttctacggtacttcctaaccgttcgggaaccctaaagggggtccaaccgggtacttaggggtaaaccgtaaagtttaaaacccggagttaggtcggggcttcggaccaccccgttattccgttaacggtttccc

SEQ ID NO: 352780 - DNA, 675 bp, Homo sapiens
  misc_feature: GZ8MTXP01DGTZN.22.73.G07.1.454.CMB.2.raw
  modified_base (199)..(199): a, c, t, g, unknown or other
  misc_feature (199)..(199): n is a, c, g, or t
  modified_base (301)..(301): a, c, t, g, unknown or other
  misc_feature (301)..(301): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaancgcccaccctctcctgcagggccagtcagagttgttagcaactaacttagtctgggtaccagcagagacctggccaggcctccaggctcctcatcatggtcncttcaccgaggcctacgtcggtactcccccgctaggttcagtcgaccccagggtgggtcgtggggaccaagggtactttccaacttcctacaacccctatcccgaggccacgtcctcgacgtaggttcttagtaaagtttagtttttcggaaccttaacttttaacttaaccgttagttaccaagggtaactaaaattaaattaaattcgttaacgttcgggtttacttaccgtacttacccgtaacccggtttccgggaacccggaaaacggggtaaccaaccgggtaaccgttagggtaaagttaacgttaaaaaccggttacgttagggttaacgggaccttaacgcctaaccttacttccttggtttccc

SEQ ID NO: 352781 - DNA, 773 bp, Homo sapiens
  misc_feature: GZ8MTXP01EYG7T.22.73.G07.1.454.CMB.2.raw
  modified_base (199)..(199): a, c, t, g, unknown or other
  misc_feature (199)..(199): n is a, c, g, or t
  modified_base (459)..(459): a, c, t, g, unknown or other
  misc_feature (459)..(459): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctaccgaggggaaanacgccaccctctcctgcagggccagtcagagtgtagactaactacttagtctaggtaccagcagacgacctggcacggtcctccgaggtcctccgtcatctagtgggtcgcctttacgaccgaaggggtcccctaacgttcgggtaaccctccccccggcgttaagggtttccaacggttcgcccccgtaaggggttcgggggtaccgtagggggaaccgtaaaggtacgtttccgacccttacgttacccaaacccgtntaccggacgtccacgtccgtaggtacgtacgttacgttaaggttaaacgtttacgtttttacgtaaccttttaactttacgttaacgttacgtactaacggtaacttaaaagttaacgttaacgttacggttaccgtttacggtttaccgttaccgttaacgttaccccgttaacccggtacccggggaaaccgggtaaacgggtaaccgttacggtaacggttaagggtaaacgttaaaacgttaaaaccggttacggtttcgggtaacggtacgtaacgtaaccctaccgttacgtttccgtttccgttccg

SEQ ID NO: 352782 - DNA, 568 bp, Homo sapiens
  misc_feature: GZ8MTXP01BX19M.22.73.G07.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (428)..(428): a, c, t, g, unknown or other
  misc_feature (428)..(428): n is a, c, g, or t
  modified_base (559)..(559): a, c, t, g, unknown or other
  misc_feature (559)..(559): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctntcctgcagggccagtcagagtgttagcaacaacttagtctgggtaccaggcaggacgacctgggccaggcctaccccgaggcctcctcattcctagtggtcgtctttcaccgagggccacgttcgggtactcccccggctaggttcagtcgccccgtagggtgggtctggggacaagtagttcactctcaccatcagcacgcctgcagtctagtaacgtttntttcgacttactttatactagtacaggtactaattataagtagtaagttcgttactacgactccgtacgtcgaccgaaggacagtacgttaggtaacgtaacttaaacgcgttggtgcgtcgacctacttnttcttgtcc

SEQ ID NO: 352783 - DNA, 665 bp, Homo sapiens
  misc_feature: GZ8MTXP01A0SMI.22.73.G07.1.454.CMB.2.raw
  modified_base (199)..(199): a, c, t, g, unknown or other
  misc_feature (199)..(199): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaanagccaccctctcctgcagggccagtcagagtgttagcaaactaacttagtctggtaccagcagacgacctgggccacggcctcccgaggtcctcctcattctatggtctcttctaccgacgggccctacgtcggtaacctcccccggacgtaggtttcaggtcgcccccgtagggtggggtctagggggactaagggtacgtttcacctctcaacctatcgacgccacgtccgtgctacgttcgtagtaaagttattttcgaaccttaacttttacgttaacttgtacaacggtaactaaattaattaaacgttgtaacgtttaggttcctacgtacttcccgtaacccgttccggaaccggtaaacgggaccgaacggtaacgttacgggtaaacgtaaacgtttaaaacggaacggttcggtaacggtccgtaacggacctaccgttattccgttcgtttaacc

SEQ ID NO: 352784 - DNA, 611 bp, Homo sapiens
  misc_feature: GZ8MTXP01E3U8P.22.73.G07.1.454.CMB.2.raw
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (421)..(421): a, c, t, g, unknown or other
  misc_feature (421)..(421): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgcccaccctctcctgcagggccagtcagagttgtagacaactaacttagtctaggtaccagcagacgacctggccaggcctccgagtcctcctnatctagtggtcncttcacgnggcctacgtcgtacnccccgntaggtcagtcgcccgtaggtgggtcgtggacaagtacgttccactctaccacgatcgacgcacgctgacagttacgtagtaagttnttttcgacctttaagtttacttacgtgtaaccaggtaactaaattaagtacgtcgttaacgttcggttacctacgtactacccgtacccgttcggaaccgaagggaccttacggtaacgttaggaaacgttaaacgttaaacgacgttcggaacggtacctaacgacctacttacgttcttcgttaaccc

SEQ ID NO: 352785 - DNA, 630 bp, Homo sapiens
  misc_feature: GZ8MTXP01D9F86.22.73.G07.1.454.CMB.2.raw
  modified_base (196)..(196): a, c, t, g, unknown or other
  misc_feature (196)..(196): n is a, c, g, or t
  modified_base (433)..(433): a, c, t, g, unknown or other
  misc_feature (433)..(433): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccacctgtctgtgtctccgaggggaangcccacctctcctgcagggccagtcagtagtgttagcaactaacttagctaggtaccagcagacgacctggccaggcctccgaggtcctcctcattctagtggtcgtcttcctacgacgggccctacgtcggtacctccccggactacgggttcaggtcgaccccgtagggttcggggtctggggaacctagtacgtttcactcctacaccatcagcagctgctagtctagtagttntttgcttatttatactgtacagtactaaattaatagtacgtacgttcgtttcgtaacgtcttaccgaccgttacggacccgtaaaaggggaccttaaggtaccgttaaggggtaaactaaaacgtttaaaaccggttaacgttgggtaaggtacttaacggaacctaccgttacgtttccgtttaacgtttaacccg

SEQ ID NO: 352786 - DNA, 584 bp, Homo sapiens
  misc_feature: GZ8MTXP01BN1X7.22.73.G07.1.454.CMB.2.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
  modified_base (334)..(334): a, c, t, g, unknown or other
  misc_feature (334)..(334): n is a, c, g, or t
  modified_base (398)..(398): a, c, t, g, unknown or other
  misc_feature (398)..(398): n is a, c, g, or t
  modified_base (561)..(561): a, c, t, g, unknown or other
  misc_feature (561)..(561): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcgacgggccagtcagtagtgttagcaactaacttagtcgtggtacccagcaggagacctggccaggcctcccgaggcctcctcatctagtggtncttccaccgagggccagtcggtaccnccccggctagggttcaggtcgccccgtaggtgggtctggggactagtagttcactctacaccgntcagcacgctgctgtctagtaagttattttcgtaccttaagttttacttacgtgtaccgaggtactaaattacgtaattcgtacgttggttacctcgtacttcccgtaccgtccggtaacgaagggtacacgtagttagagtaacttaacgttcgttggtcgngtcgactaccttatcgttcgtcc

SEQ ID NO: 352787 - DNA, 667 bp, Homo sapiens
  misc_feature: GZ8MTXP01CA7OM.22.73.G07.1.454.CMB.2.raw
  modified_base (199)..(199): a, c, t, g, unknown or other
  misc_feature (199)..(199): n is a, c, g, or t
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
  modified_base (404)..(404): a, c, t, g, unknown or other
  misc_feature (404)..(404): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgcccaccctctcctgcagggccagtcaggagtgtagcaactacttgtctggtaccagcagagacctggccaggcctccgaggcctcctcattctagtggtcgcttccgaccgngggccctagtcggtacctcccccgngtacggttcaggtcgcccccgtaggtgggtctaggggactaagggtacttcacgttccactaccgntaccgagcctacgtcctggacctagttaccgtaggtaaacgtttcgtttacgaccttaacgttttactaacgtggttacctaagggtaacttaaattaagttaacgttacgtacgttcgggttacctacggtacttacccgtacccggttcggaacccggtaaacggggacccttaacgggtacgttagggaaacgttaacgttaaaaacgcgttcgggtaacggtcttaacggaccctacttacgttccttaacggtttccc

SEQ ID NO: 352788 - DNA, 684 bp, Homo sapiens
  misc_feature: GZ8MTXP01BZ1RL.22.73.G07.1.454.CMB.2.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
tcagacatacgcgtcacgaccggtgctcgatttagctctacgctcagggggaggaactgctcagttaggacccagacggaaccatggaagccccagcgcagcttctcttcctccttctactctggctcccagataccactggagaaatagtgatgacgcagtctccagccaccctgtctgtgtctccgaggggaaancgcccaccctctcctgcagggccagtcagagtgtancaactaacttagtctggtaccagcagacgacctggccaggcctccgaggcctcctcattctatggtctcctttcgtaccgacgggggccctaacgttcggtacccttcccccggacgtacgggtttcagggttcgcccgtaggggtcggggttcgtagggggaaccaggtacgtttcccaacttcctacccaacgtataccgacgctaacgccgttcgacgtacgtcgttagtaaagttactttttcgtacttacttttaattacgttactacgtaacgtactaaatttaattaattaggtaccttcggttcctacgtacgttaccgtaacccgttaccggaccgtaaacggggaacctacggttaacggttaggttaaacgtaaacgttaaaccggttaacgttcggttaggtccgttgaaccctactacttacgtcgttcgtttaaccg

SEQ ID NO: 352789 - DNA, 568 bp, Homo sapiens
  misc_feature: GZ8MTXP01DLEQ1.22.73.G07.1.454.CMB.2.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
  modified_base (348)..(348): a, c, t, g, unknown or other
  misc_feature (348)..(348): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaacctgtctgtgtctccaggggaaangccaccctctcctgcagggccagtcagagtgttagcaacaacttagtctggtaccagcagacgacctggccaggctcccaggctcctcatctatggtncttctaccagggccatggtacnccccgcaggttcagtcgccccgaggtgggtcnggggacaagcgttcactctcaccatcagcagcctgcagtctagtaaagtatttttcgactacgttttaatttaactgttcctaaggggactaaattaattaaattgtaaccttggtttcctacggtacttcctaccgttccggaccgaaacgggtcacgaccgttaggaagtaacgttaaaacgaacgttggtcggctgtcccgacttagtccttcgttc

SEQ ID NO: 352790 - DNA, 499 bp, Homo sapiens
  misc_feature: GZ8MTXP02HMOKX.22.73.G07.1.454.CMB.2.raw
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
  modified_base (389)..(389): a, c, t, g, unknown or other
  misc_feature (389)..(389): n is a, c, g, or t
tcagacatacgcgtcacgaccggtgctcgatttagctctacgctcaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggctcccaggctcctcatctatggtncttctaccagggccatggtactccccgcaggttcagtgccccagtgggtctggggacagagttcactctcaccatcagcagcctgcagtctgaagtntttgctactttatactgtcagctaatataatgactggttactcgatcaccgttcggacctaagggacacgactggaacgattaaacgaactgtaaggctgcacatctgtc

SEQ ID NO: 352791 - DNA, 531 bp, Homo sapiens
  misc_feature: GZ8MTXP02FYB9N.22.73.G07.1.454.CMB.2.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgcagggccagtcagattgtagcaactaacttagtctggtaccagcagagacctggccaggcctcccaggcctcctcatctatggtncttctaccagggcccacgtggtactccccgctaggttcaggtgccccagtgggtctggggacagtacgttcactctacaccatcagcagcctgcagtctagaagtcttttgcttactttatacttgtacagtacaatataaatgaacttggttctcgtatcaccgttcgacaaagggacacgactaggaagtaacttaaaacgacgttgaaggctacgacactatctcgttacc

SEQ ID NO: 352792 - DNA, 537 bp, Homo sapiens
  misc_feature: GZ8MTXP02JVXTO.22.73.G07.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggctcccaggctcctnatctatggtncttcaccgagggccacgtggtactccccgcaggttcagtgccccagtgggtctggggacaggngttcactctcaccatcagcagcctgcagtctagagtattttgcttactttattactgtcagactaatataatgacttggttctcgtatcctaccttcggacctaacggggacacggacgtggaacgtaacgttaaacgaacgttgtaacggtctacggacctaccgacttcgttcgttacc

SEQ ID NO: 352793 - DNA, 556 bp, Homo sapiens
  misc_feature: GZ8MTXP02G878K.22.73.G07.1.454.CMB.2.raw
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
  modified_base (392)..(392): a, c, t, g, unknown or other
  misc_feature (392)..(392): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtgttagcaacacttagtctggtaccagcagagacctggccaggctcccaggcctcctcatctatggtncttctaccagggccactggtactccccgctaggttcagtcgccccaggtggtctggggacagacgttcactctcaccatcagcagcctgcagtctgagtntttgctactttatactgtcagctaatataatgtacttggttactcgatccgtaccgttcggaccctaaaggggaccacggtacgtagggaaacgtaacgtttaaaaccggaacgttggtaacgggccttacggaccctaacccgtacgtttcctacggtttccc

SEQ ID NO: 352794 - DNA, 545 bp, Homo sapiens
  misc_feature: GZ8MTXP02I5FRD.22.73.G07.1.454.CMB.2.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (402)..(402): a, c, t, g, unknown or other
  misc_feature (402)..(402): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagtctggtaccagcagagacctggccaggctcccaggcctcctcatctatggtncttcaccgagggccactggtactccccgctaggttccagtcgccccgagtggggtctggggacaggacgttcactctacaccatcagcagcctgcagtctgaagttntttgacttatttatactgtacagactaattataagtgtacgttgttctacgtacttccgtaccgtcgggacgaacgggtaccacgtacgtaggaactaacgttaaaacgacgttaggtcgtctacgaccacctattctacgtc

SEQ ID NO: 352795 - DNA, 502 bp, Homo sapiens
  misc_feature: GZ8MTXP02JK59K.22.73.G07.1.454.CMB.2.raw
  modified_base (196)..(196): a, c, t, g, unknown or other
  misc_feature (196)..(196): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacaacttagtctggtaccagcagagacctggccaggctcccaggcctcctcatctatggtgcttctaccgagggccacgtggtactccccgcaggttcagtgccccagtgggtctggggacagagttcactctcaccntcagcagcctgcagtctgaatntttgctatttatactgtcagctaatataatgactgtctcgatcacgttcggacaagggtcacgactagggactagttaaaacgactgtcggctcgcactatctagttcc

SEQ ID NO: 352796 - DNA, 493 bp, Homo sapiens
  misc_feature: GZ8MTXP02J0PSF.22.73.G07.1.454.CMB.2.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacacttagtctggtaccagcagagacctggccaggctcccaggctcctnatctatggtgcttctaccagggccactggtactccccgcaggttcagtgcccagtggtctgggacagagttcactctcaccatcagcagcctgcagtctgagtatttgctactttatactgtcagcaatatatgactggttctgatcaccttcggacctaagggacacgactagggacattaaacgaactgtaagctgctaccatctgttc

SEQ ID NO: 352797 - DNA, 512 bp, Homo sapiens
  misc_feature: GZ8MTXP02IRYG5.22.73.G07.1.454.CMB.2.raw
  modified_base (195)..(195): a, c, t, g, unknown or other
  misc_feature (195)..(195): n is a, c, g, or t
  modified_base (373)..(373): a, c, t, g, unknown or other
  misc_feature (373)..(373): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccacctctcctgcagggccagtcagagtgttagcaacacttagctggtaccagcagagacctggccaggctcccaggcctctcatctatggtgcttctaccagggccactgggtactcccccgcctaggttcagtcgcccctaggtgggtctggggacaggtagttcactctcaccntcagcagcctgcagtctgaagtattttgctactttatactgtcagctaatatatgacttggttctcgatcaccgttcggacctaagggacacgacgtaggagtaattaaaacgactagtggctgacaccattctgttcc

SEQ ID NO: 352798 - DNA, 533 bp, Homo sapiens
  misc_feature: GZ8MTXP02HRN7T.22.73.G07.1.454.CMB.2.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatagacgcagtctccagccaccctgtctgtgtctccgaggggaaangccaccctctcctgcagggccagtcagagtgttagcaacaacttagtctggtaccagcagagacctggccaggctcccaggcctcctcatctatggtncttcaccgnggcccatggtactccccgctaggttcagtcgccccaggtgggtctggggacagagttccactctcaccntcagcagcctgcagtctagaagttntttgacttatttatctgtacagtactaattataagtgtacttggttactacgtacttcctaccgtcgaccgaaacgggacacgtacgtaggaacgtaacgtaaacgagtgtcggactacgacactcttcttctc

SEQ ID NO: 352799 - DNA, 544 bp, Homo sapiens
  misc_feature: GZ8MTXP02FUDT5.22.73.G07.1.454.CMB.2.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
  modified_base (391)..(391): a, c, t, g, unknown or other
  misc_feature (391)..(391): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctctcctgcagggccagtcagagtgttagcaacacttagtctggtaccagcagagacctggccaggcctcccaggcctcctcatctatggtncttctaccagggccactggtactccccgcaggttcagtcgcccagtggtctgggacagagttcactctcaccatcagcagcctgcagtctgaagtnttttgcttactttattactgtcagtactaatataatgtacttggttctcgtatcctaccgttcggaccctaaaggggaccaacggtacgtaggaacgtaacgttaaaacgaacttggtaaggtctacggacctaaccgtattccgtcgtttcc

SEQ ID NO: 352800 - DNA, 530 bp, Homo sapiens
  misc_feature: GZ8MTXP02JZXRD.22.73.G07.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacaacttagtctggtaccagcagagacctggccaggctcccaggctcctnatctatggtncttctaccagggccactggtactccccgcaggttcagtgccccagtggtctggggacagagttcactctcaccatcagcaacctgcagtcngaagttntttcgacttactttatactgtacagtactaatataatcgtaacttggttactacgactcctaccgttcgaccgaaaggacacgacgacggaaagtaactaaaacgacgttaggcggtcgtcgacacctatctcgttctc

SEQ ID NO: 352801 - DNA, 505 bp, Homo sapiens
  misc_feature: GZ8MTXP02FOJU4.22.73.G07.1.454.CMB.2.raw
  modified_base (196)..(196): a, c, t, g, unknown or other
  misc_feature (196)..(196): n is a, c, g, or t
  modified_base (435)..(435): a, c, t, g, unknown or other
  misc_feature (435)..(435): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccactggtactccccgcaggttcagtgccccagtgggtctggggacaggagttcactctcaccatcagcagcctgcagtctgaagattttgactactttatactgtcagcaatataatgactggttacngtatcaccttcggaccaagggacacgactaggagtacttaaaaccgatgtaaggctagcaccatctgttc

SEQ ID NO: 352802 - DNA, 556 bp, Homo sapiens
  misc_feature: GZ8MTXP02GCM6Z.22.73.G07.1.454.CMB.2.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcaacacttagctggtaccagcagagacctggccaggctcccaggcctcctcatctatgggtncttctaccgagggccacgtggtactccccgcaggttcagtcgccccagtgggtctggggacaggagttcactctacaccntcagcagcctgcagtctagaaagttntttgacttatttatactagtacagtactaatataatgtacttgttactacgtactcctaccgttacggaaccgaaacgggaccaacggtacgtaggaaacgtaaacgttaaaacgacgttggtaacggctacgacctaaccgtacttccttacgttc

SEQ ID NO: 352803 - DNA, 588 bp, Homo sapiens
  misc_feature: GZ8MTXP02JMZ6G.22.73.G07.1.454.CMB.2.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacacttgtctggtaccagcagacgacctggccaggcctcccaggcctcctcatctatggtgtcttctaccgagggccctacgttcgggtactccccccggactagggtttccaggtcgcccccgtagggtcggggtctggggacaggtacgtttccaacttctaccaccctatccagcctagccctggcagtctagaagttatttcgacttactttattactgtcagtactaattataatgtacttggttctcgattccaaccgttcggaccaagggtcacgtacgtaggaacgtaacttaaaacgacgttggtaaccggtactacggtacccacgtacttccgttacgtttcc

SEQ ID NO: 352804 - DNA, 661 bp, Homo sapiens
  misc_feature: GZ8MTXP02F7WN8.22.73.G07.1.454.CMB.2.raw
  modified_base (196)..(196): a, c, t, g, unknown or other
  misc_feature (196)..(196): n is a, c, g, or t
  modified_base (461)..(461): a, c, t, g, unknown or other
  misc_feature (461)..(461): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangcccaccctctcctgcgagggccagtcagagtgttagcaactaacttagtctggtaccagcagacgacctggccaggcctcccgaggcctcctcatctagtggtcgtcttactaccgagggccctacgtcggtacctcccccgcgtaggttccaggtcgcccccgtagggttcgggtcgtggggactaggtacgtttccaccttccgtaccaaccctagtaccacgcctacgcccttagacctaggttccgtaaggtaaacgttntttttacggacctttaacttttattacttggttaccaggtactaaattaattaaagttcgtaacgttggtttacctacgtacttccgtacccgttcgggaaccgtaaaacgggacctaacggtaccggtaggaaacgttaaacgttaaaacgtcgttaggtcggtactacggaccctaaccgtacgtctttcgtttaccc

SEQ ID NO: 352805 - DNA, 582 bp, Homo sapiens
  misc_feature: GZ8MTXP02IXPGQ.22.73.G07.1.454.CMB.2.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (426)..(426): a, c, t, g, unknown or other
  misc_feature (426)..(426): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctccagataccactggaagaaatagtgatgacgcagtctccagccaccctgtctgtgtctccgaggggaaangcccaccctctcctgcagggccagtcagagtgttagcaaactaattgctaggtaccagcagagacctggccaggcctcccaggcctcctcatctatggtncttcacnggccagtgtactcccgctaggttcagtcgcccaggtcggtcgtgggacagtagttccactctaccaccatcagcagcctgctgtctagtaagtattttgacttactttattactgttacaanactaaatataatcgtaacttggttactcgtaacttcctaccgttcggaaccgtaaaacggggactaaaccgacggtaagggtaaagtaaacgtttaaaaaccggaacgttagggtaacgccgttaggaccctaactaacgttcgtttacgtttccc

SEQ ID NO: 352806 - DNA, 528 bp, Homo sapiens
  misc_feature: GZ8MTXP02IDYRG.22.73.G07.1.454.CMB.2.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
  modified_base (448)..(448): a, c, t, g, unknown or other
  misc_feature (448)..(448): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagcaacaattagtctggtaccagcagagacctggccaggcctcccaggcctcctcatctatggtncttctaccgngggccacgtggtactccccgcaggttcagtcncccctaggtggggtcctggggacaggtacgtttccacttctccaccatcgagcacgcctgcagtctagtaagttattttgacttatttattactgtcagactaaatataatnacttgttctgatcacgtcggactaacggacagactaggagtaacttaaacgactggtcggctcgcaacctctcttacgtc

SEQ ID NO: 352807 - DNA, 515 bp, Homo sapiens
  misc_feature: GZ8MTXP02IAQIR.22.73.G07.1.454.CMB.2.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (394)..(394): a, c, t, g, unknown or other
  misc_feature (394)..(394): n is a, c, g, or t
tcagacatacgcgtcacgaccggtgctcgatttagctctacgctcaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtncttctaccnggccatggtactccccgcaggttcagtgccccagtggggtctggggacaggacgttcacttctcaccatcagccagcctgcagtctgaagtnttttgctactttattactgtcagctaattataatgtactggttactcgatcaccttcggacctaagggacacgacgtaggaagtacgtaaacgaactgtaacggctcgacaccatctgtcc

SEQ ID NO: 352808 - DNA, 570 bp, Homo sapiens
  misc_feature: GZ8MTXP02I0VJN.22.73.G07.1.454.CMB.2.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaacacttagctggtaccagcagagacctggccaggctcccaggctcctcatctatggtncttctaccgngggccatggtactccccgctaggttcagtcgcccctaggtcgggtctaggggacaggtagttccactctacaccatcagcagcctgcagtctagaattatttgacttaactttatactgtcagactaatataatgacttggttctcgtatcctaccgttcggaccctaaaggggacctaacggacgttagggaaacgttaaacgttaaaaccggaacgttggtaacgggccttacggaccctaaccgtagtttcccttagtttaccc

SEQ ID NO: 352809 - DNA, 566 bp, Homo sapiens
  misc_feature: GZ8MTXP02GXHNN.22.73.G07.1.454.CMB.2.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggcctcccaggcctcctcatctatggtncttctaccgagggccacgtcgggtactcccccgcaggttcaggtcgccccaggtgggtctggggacaggacgtttcacttctcaccatcagcagcctgcagtctagaacgtattttgacttactttattacgttgtccagtactaattataatgacttggttctacgtactcctaaccgttcggaccgaacgggaccaacgtacgtaggaaacgtaacgttaaaacgacgttaggtaagtcgtacggacctaacctattaccgttgttcc

SEQ ID NO: 352810 - DNA, 525 bp, Homo sapiens
  misc_feature: GZ8MTXP02IPVN7.22.73.G07.1.454.CMB.2.raw
  modified_base (196)..(196): a, c, t, g, unknown or other
  misc_feature (196)..(196): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcaganaccnggccaggctcccaggctcctnatcatggtnctctaccaggccactggtactccccgcaggttcagtgcccagtggtctggggacaggattcactntccacntcagcagcctgccagtctgaaagttntttntctacttattatatatanataataatatagtacgtgttactactactactaccgtacgacgaacggacgacgacgtaggaacgtaacgtaaacgtaacgtagtaagtcgtacgtacacctactactacgtc

SEQ ID NO: 352811 - DNA, 534 bp, Homo sapiens
  misc_feature: GZ8MTXP02GVJZV.22.73.G07.1.454.CMB.2.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacacttagtctggtaccagcagagacctggccaggctcccaggcctcctcatctatggtncttctaccgagggccactggtactccccgcaggttcagtgcccctagtgggtctggggacagagttcactctcaccatcagcagcctgcagtctgaagtatttgctactttatactgtcagctaatatatgactggttctcgaactctaccgttcggaccctaagggacacgacgtaggaacgtaactttaaaacggaacttggtaacggcttacggaccacccgtattccttacgtttcc

SEQ ID NO: 352812 - DNA, 570 bp, Homo sapiens
  misc_feature: GZ8MTXP02I4PY5.22.73.G07.1.454.CMB.2.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
  modified_base (406)..(406): a, c, t, g, unknown or other
  misc_feature (406)..(406): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtgttagcaacaacttgtctggtaccagcagagacctggccaggcctcccaggcctcctcatctatggtncttctaccgagggcctacgtggtactccccgctaggttcaggtcnccccgaggtcgggtctaggggacaggtacgttcactctcaccatcagcagcctgcagtctagaagttntttgacttaactttatacgttgtacagtactaaattataattgtacgttcggttactacgtacttccgtaccgttacggaaccgtaacggacaacggtacgtaggaaacgtaaacgttaaaacgagttacggtcggtctacgacctaacgtacttcgtacgttc

SEQ ID NO: 352813 - DNA, 546 bp, Homo sapiens
  misc_feature: GZ8MTXP02JLSNT.22.73.G07.1.454.CMB.2.raw
  modified_base (196)..(196): a, c, t, g, unknown or other
  misc_feature (196)..(196): n is a, c, g, or t
  modified_base (371)..(371): a, c, t, g, unknown or other
  misc_feature (371)..(371): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgttagcaacacttagtctggtaccagcagagacctggccaggctcccaggctcctcatctatggtgcttctaccgagggccacgtgggtactccccgctaggtcagtgccccaggtcgggtctggggacagagttcactctcaccntcagcacgcctgcagtctagatatttgactatttatacttgtcagtctaatataatcgtattagggttctcgtactcgtaccgttcggaccaaacggggtacacgacgtgggaacgtaacgttaaaaccgaacttggtaacggcttacggacctaccctattaccgttacgttcc

SEQ ID NO: 352814 - DNA, 624 bp, Homo sapiens
  misc_feature: GZ8MTXP02I87SU.22.73.G07.1.454.CMB.2.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (431)..(431): a, c, t, g, unknown or other
  misc_feature (431)..(431): n is a, c, g, or t
tcagacatacgcgtcacgaccggtgctcgatttagctctacgctcagggggaggaactgctcagttaggacccagacggaaccatggaagccccagcgcagcttctcttcctcctgctactctggcctcccagataccactggagaaatagtgatgacgcagtctccagcccaccctgtctgtgtcctccgaggggaaangcccaccctctcctgcagggccagtcagagtgttagcaacacttagctggtaccagcagagacctggccaggcctcccaggcctcctcatctatggtnccttctacccgagggccctacgtcgggtactcccccgctagggtttccaggtcgccccgaggtcggggtcctggggaccaggtagttccaactctccaacctatcagccagccctggccagtctagaaagttntttacgacttacgtttatacgttgtactagtactaaatattaagtacgtacgttacggttcctacgtactacccgtaccgttaccgggaaccgtaaacgggaccaccggtacgtaagggtaaacgttaaacgttaaaaccggacgttaggtaacggtacctacgtaccctaactacgtttccgttacgttacc

SEQ ID NO: 352815 - DNA, 499 bp, Homo sapiens
  misc_feature: GZ8MTXP02GGKGA.22.73.G07.1.454.CMB.2.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggctcccaggctcctcatctatgggtnctttcaccngggccactggtactccccgcaggttcagtnccccagtgggctggggacaggagttcactctcaccatcagcagcctgcagtctgaagattttgctactttatactgtcagcaatataatgactggttctgtatcaccttcggaccaagggacacggactggataacttaaacgaactgtaagctagcacatctgtc

SEQ ID NO: 352816 - DNA, 546 bp, Homo sapiens
  misc_feature: GZ8MTXP02JTKOH.22.73.G07.1.454.CMB.2.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (420)..(420): a, c, t, g, unknown or other
  misc_feature (420)..(420): n is a, c, g, or t
  modified_base (465)..(465): a, c, t, g, unknown or other
  misc_feature (465)..(465): n is a, c, g, or t
  modified_base (522)..(522): a, c, t, g, unknown or other
  misc_feature (522)..(522): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaactattagtctggtaccagcagagacctggcccaggcctcccgaggcctcctcatctatggtncttcaccgagggccacgtcgggtacctccccggctaggttcaggtcgccccgtaggtcggggtctggggactaggtacgttccactctaccacatcagcacgtcctgctagtctagtaagtntttgacttactttatactgtcagactaatatatgtacttggttcncgtatcctacgtcggacctaagggacacggacgtaggaacgtaactaaacgacgtgngctacgacctacacgttctgttcc

SEQ ID NO: 352817 - DNA, 513 bp, Homo sapiens
  misc_feature: GZ8MTXP02FY5TV.22.73.G07.1.454.CMB.2.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
  modified_base (403)..(403): a, c, t, g, unknown or other
  misc_feature (403)..(403): n is a, c, g, or t
  modified_base (506)..(506): a, c, t, g, unknown or other
  misc_feature (506)..(506): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtgttagcaacacttagtctggtaccagcagagacctggccaggcctcccaggcctcctcatctatggtncttcaccgagggccacgtggtactcccccggctaggttccaggtcgccccgtaggtcgggtctggggacaggtacgttcactctcaccatcagcagcctgcagtcagatntttgactctttatactgtcagtcaatataatgtactggttcacgtatcaccgttcgacaagggcacgactggaactagttaaacgcttgcgctagactacctntctcgtc

SEQ ID NO: 352818 - DNA, 592 bp, Homo sapiens
  misc_feature: GZ8MTXP02F8M4S.22.73.G07.1.454.CMB.2.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (376)..(376): a, c, t, g, unknown or other
  misc_feature (376)..(376): n is a, c, g, or t
  modified_base (404)..(404): a, c, t, g, unknown or other
  misc_feature (404)..(404): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacacttagtctggtaccagcagagacctggccaggcctcccaggcctcctcatctatggtcncttctaccgngggccagtggtactccccgcaggttcagtcgccccaggtgggtctggggacaggtagttccactctcaccntcagcacgcctgcagtctagtaaacgtnttttgacttactttacgttacttagtactagtactaaattaattaagtgtaaccgttggttacctacggtactcccgtaccgttccgggaacccgtaaacgggacccgtaacggtacgtaggggaacgtaacgttaaaacggaacgttggtaacggtctacggacctaccgtacttccgtcgtttacc

SEQ ID NO: 352819 - DNA, 581 bp, Homo sapiens
  misc_feature: GZ8MTXP02GR7HW.22.73.G07.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
  modified_base (420)..(420): a, c, t, g, unknown or other
  misc_feature (420)..(420): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangccaccctntcctgcagggccagtcagtagtgttagcaactaacttgtctggtaccagcagagacctggccaggcctcccgaggtcctcctcatctagtggtctcttctaccgnggggcctagtcggtactccccgctaggttcaggtcgccccgaggtggtctggggacaggtacgttcactcgtacacctatcgagccacgcctgctagtctagtaagtttntttcgacttactttacttactacgtactagtacttaaattattaagtacgtacgttcggttactacgtactccgtaccgttcggaaccgtaacggacacggtacgtaggtaacgtaaacgttaaacgagttgtaacgtcacgacctactacgtcctacgtc

SEQ ID NO: 352820 - DNA, 625 bp, Homo sapiens
  misc_feature: GZ8MTXP02H2EQA.22.73.G07.1.454.CMB.2.raw
  modified_base (305)..(305): a, c, t, g, unknown or other
  misc_feature (305)..(305): n is a, c, g, or t
  modified_base (433)..(433): a, c, t, g, unknown or other
  misc_feature (433)..(433): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgcccaccctctcctgcagggccagtcagagtgttagcaactaattagtctggtaccagcagacgacctggccaggcctcccgaggcctccctcattcattgggtcnccttaccaccgagggccctacgtggtactccccgctaggttcagtcgccccgtaggttcgggtcgtaggggactaggtacgtttcaccttctaccacctatcgagccagccctgcagtctagtaattnttttgacttacttttatactgttacagtactaaattataaagttgtaacttggttacctacggacttaccgtaccgttaccgggaacccgaaacggggtaaccaacggtaaacgtgggaaaacgtaaaccgtttaaaaacggaactcggttaaggacccttagaccctaaacccgttctttccgtttacgtc

SEQ ID NO: 352821 - DNA, 575 bp, Homo sapiens
  misc_feature: GZ8MTXP02JE9W4.22.73.G07.1.454.CMB.2.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (427)..(427): a, c, t, g, unknown or other
  misc_feature (427)..(427): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaancgccaccctntcctgcagggccagtcagagtgttagcaacacttagtctggtaccagcagagacctggccaggcctcccgaggtcctccgtacattctagtgggtctcctttactaccgagggcctacgtcgggtacctccccgcgtaggttccagtcgcccgtaggtcgggtctggggacaggtacgttcactctacaccatcagcagcctgcagtctagtaatgtttnacttattattactgtacagtactaatataatgtacgttgttactacgtactcctaccgttcggaccgaaacgggtaccacgtacgtaggtaaacgtaacgttaaaacgacgttgtaacggtctacgacctacctatttccgtatttcc

SEQ ID NO: 352822 - DNA, 608 bp, Homo sapiens
  misc_feature: GZ8MTXP02F2BO6.22.73.G07.1.454.CMB.2.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (300)..(300): a, c, t, g, unknown or other
  misc_feature (300)..(300): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctntcctgcagggccagtcagagtgttagcaactaacttagtctggtaccagcagagacctggccagggcctcccgaggcctcctcatctatggtntcttcaccgagggccacgtgggtacctcccccggactaggttcaggtcgcccctaggtcgggtctaggggacaggtacgttccacttctaccacctatcagcagcctagctagtctagtaagtattttgacttactttacttacttgtacaagtactaaattactaagtgtacgttggttactacgtatcccgtaccgttcgggaccgtaaacggggaccacggtacgtagggaaacgtaacgtttaaaacgacgtttagggaacggtacgttacggaccctaaccgtacttaccgttacgtttaccc

SEQ ID NO: 352823 - DNA, 545 bp, Homo sapiens
  misc_feature: GZ8MTXP02JAO8D.22.73.G07.1.454.CMB.2.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
  modified_base (336)..(336): a, c, t, g, unknown or other
  misc_feature (336)..(336): n is a, c, g, or t
  modified_base (397)..(397): a, c, t, g, unknown or other
  misc_feature (397)..(397): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggcctcctnatctatggtgcttcaccagggccagtcggtactcccccgcaggttcaggtnccccaggtgggtctggggacaggagttcactctcacatcagcagcctgcagtctgaagttntttcgacttactttattacttgtacagtactaattatatcgtacttggttactacgtactcctaccgtcggacgaacggacacggacgtaggaacgtaaacgttaaacgacgtaggtaacggctacgacctacctacttcgtacgttc

SEQ ID NO: 352824 - DNA, 545 bp, Homo sapiens
  misc_feature: GZ8MTXP02J1ICN.22.73.G07.1.454.CMB.2.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccaccctctcctgcagggccagtcagagtgttagcaacaattgtctggtaccagcagagacctggccaggctcccaggctcctnatctatgggtncttcaccgnggccagtgggtactcccccgcaggtttcagtgccccaggtgggtctggggacagagttcactctcacatcagcacgcctgctgtcngaagtntttgcttatttatctgtctagctaaattataatgtacttggttctacgtactccgtaccgttcggaccgaaacgggaccacggtacgtagggaataacgtaaaaccgtagttaggtcggtctacggacctaaccgttcttcgttcgttc

SEQ ID NO: 352825 - DNA, 632 bp, Homo sapiens
  misc_feature: GZ8MTXP02H9HE4.22.73.G07.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagacatacgcgtcacgaccggtgctcgatttagctctacgctcagggggaggaactgctcagttaggacccagacggaaccatggaagccccagcgcagcttctcttcctcctgctactctggcctcccagataccactggagaaatagtgatgacgcagtctccagccaccctgtctgtgtctccaggggaaangccaccctctcctgcagggccagtcagagtgttagcaacaacttagtctggtaccagcagagacctggccaggcctcccaggctcctnatctagtggtnacttactacccgagggccctacgttgggtacctcccccggacgtagggttcaggtcgccccgtagggttcggggtcaggggtacaggtacgtttccaaccgttctaccacctatccgagccacgcctgcctagtctagtaagttattttcgacttactttacttactcgttcaagtactaaattataatagtacgttggttactacggacttaccgtaccgtttccggggacccgtaaacgggacctaccggacgttaggggaaacgtaaacgtttaaaaccggaacgttacggtaacggtacctacggacctaaccctagttcctttacgtaccc

SEQ ID NO: 352826 - DNA, 584 bp, Homo sapiens
  misc_feature: GZ8MTXP02G44YJ.22.73.G07.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
  modified_base (543)..(543): a, c, t, g, unknown or other
  misc_feature (543)..(543): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangccaccctntcctgcagggccagtcagagtgttancaactacttagctaggtaccagcagacgacctggccaggcctcccgaggcctcctcatctagtggtgcttctacgngggcctacgtggtactccccgctaggttcagtgccccgtaggtcgggtctggggacaggtacgttcactctcaaccgtntacgagcacgtcctgacagtctagtaattntttgacttactttattacgttgtaccaagtactaattaataagtagtacgttggttactacgacttcctaccgttacggaccgtaacgggacctacggacgttagggaaataacgtttaaaaccggnttacggtcggtactacggacctaactcttccgtacgtttcc

SEQ ID NO: 352827 - DNA, 589 bp, Homo sapiens
  misc_feature: GZ8MTXP02IZ1N6.22.73.G07.1.454.CMB.2.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttagcaacaacttagtctggtaccagcagagacctggccaggcctcccaggcctcctcatctatgggtnctttcaccgaggcccacgtcgggtactcccccggccaggtttccaggtcgccccgtaggtcggggtctaggggaccaggacgttccaccttctaccacctatcagccacgcctgctagtctagtaagtattttgacttaactttattacgttgtacagtactaaatataatagtacttcggttactcgattcctaccgttcgaaccgtaacggggacacggacgtagggaacgtaacttaaaacgacgttaggtaacggtctacggacctaacgtacttccgtacgtttcc

SEQ ID NO: 352828 - DNA, 566 bp, Homo sapiens
  misc_feature: GZ8MTXP02FQRXV.22.73.G07.1.454.CMB.2.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttagtctggtaccagcagagacctggccaggctcccaggctcctcatctatggtncttctaccgngggcccacgtggtactcccccggcctaggttcaggtcgcccctagggtcgggtcgtggggacaggtacgttccacttctaccaccgtatccagccagccctgcagtctagaagtnttttgaccttatttactactgtacanactaattataatgtacttggttctgactccaccgttcggaccctaaaagggcaacggacttagggaactaaacgttaaaacgacgttggtcggtctacggaccacctattcctgtttacc

SEQ ID NO: 352829 - DNA, 562 bp, Homo sapiens
  misc_feature: GZ8MTXP02GYEF2.22.73.G07.1.454.CMB.2.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
  modified_base (418)..(418): a, c, t, g, unknown or other
  misc_feature (418)..(418): n is a, c, g, or t
  modified_base (550)..(550): a, c, t, g, unknown or other
  misc_feature (550)..(550): n is a, c, g, or t
tcagacatacgcgtcacgaccggtgctcgatttagctctacgctcagggggaggaactgctcagttaggaccaagacggaaccatggaagccccagcgcagcttctcttcctcctactactctggctcccagataccactggagaaatagtgatgacgcagtctccagccaccctgtctgtgtctccgaggggaaancgccaccctctcctgcagggccagtcagagtgttagacaacaacttgtctggtaccagcagacgacctggccaggcctcccgaggcctcctcatctagtggtntcttcaccgagggccacgtggtaccctcccccggctaggttcaggtcgccgtaggtcggggtcaggggacaggtacgttcactccacaccatcaagcacgcctgcagtctagaaagtntttcgacttaatttatactgtacagactaaattataatcgacttggttctacgtactaccgtaccgttacggaccaaaggggaccacgtacgtaggaataaacttaaaacgactggacgctggaccaacgtntcgtcttacttc

SEQ ID NO: 352830 - DNA, 623 bp, Homo sapiens
  misc_feature: GZ8MTXP02GU69E.22.73.G07.1.454.CMB.2.raw
  modified_base (306)..(306): a, c, t, g, unknown or other
  misc_feature (306)..(306): n is a, c, g, or t
  modified_base (457)..(457): a, c, t, g, unknown or other
  misc_feature (457)..(457): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgccacccctctcctgcgagggccagtcagagtgttagacaactaacttagtctggtaccagcagagacctggccaggcctcccgaggcctcctcattctagtgggtntccttccgtaccgagggccacgtcggtacctccccggctagggttccaggtcgaccccgtagggtggggtctggggaactagggtacgtttccacttcacccaacctatccgaaggcccacgtccctggaccgtaggttctaggtaagttntttgtacttactttattacgttagtacagtactaatattaatcgtacgttgttactacgtacttccgtaccgtacggaccgtaaacgggtacacggtacgtaggtaaacgtaacgtaaaaccggtacgtaggtaacggtcacgacctacgtacttcgtacgtttcc

SEQ ID NO: 352831 - DNA, 583 bp, Homo sapiens
  misc_feature: GZ8MTXP02JUBX1.22.73.G07.1.454.CMB.2.raw
  modified_base (198)..(198): a, c, t, g, unknown or other
  misc_feature (198)..(198): n is a, c, g, or t
  modified_base (416)..(416): a, c, t, g, unknown or other
  misc_feature (416)..(416): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagccaccctctcctgcagggccagtcagagtgttagcaacacttagtctggtaccagcagagacctggccaggcctcccaggcctcctcatctatggtgtcttcaccgagggccaacgtcgggtactcccccggctacggttcaggtcgcccctaggtcggggtctggggacagacgttcacgtctcaccatcagcacgccctagctagtctgaagtntttgcttattttacttactgtcagtactaaatataatgtacttcgggttactcggtatccgtacccgttcgggaccgtaaaggggaccacggtacgtaggggtaactaaacgttaaaacggaactttggtcggaccttacggaccaccctagttccttcggtttacc

SEQ ID NO: 352832 - DNA, 496 bp, Homo sapiens
  misc_feature: GZ8MTXP02JZ00B.22.73.G07.1.454.CMB.2.raw
  modified_base (196)..(196): a, c, t, g, unknown or other
  misc_feature (196)..(196): n is a, c, g, or t
  modified_base (354)..(354): a, c, t, g, unknown or other
  misc_feature (354)..(354): n is a, c, g, or t
  modified_base (430)..(430): a, c, t, g, unknown or other
  misc_feature (430)..(430): n is a, c, g, or t
  modified_base (480)..(480): a, c, t, g, unknown or other
  misc_feature (480)..(480): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttcaccagggccatggtactccccgcaggttcagtgccccagtgggtctggggacaggngttcactctcaccatcagcagcctgcagtctgagtatttgctactttatactgtcagcaatataatgactggttcncgatcaccttcggaccaagggacacgacgtggaacgtactaaacgactgngctgcactatcgtatc

SEQ ID NO: 352833 - DNA, 542 bp, Homo sapiens
  misc_feature: GZ8MTXP02IAYBD.22.73.G07.1.454.CMB.2.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (344)..(344): a, c, t, g, unknown or other
  misc_feature (344)..(344): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccatggagaaatagtgatgacgcagtctccagccaccctgtctgtgtctcaggggaaangccaccctntcctgcagggccagtcagagtgtagcaanacttagctggtaccagcagagacctggccaggctcccaggctcctnatctatggtncttctacgaggccactggtactcccgcaggttcagtgcccagtggtctgggacagngttcatctcacatcagcagcctagcagtctgaatattttgactacttttattaactggttacagtataaatataaatcgtaactgggttactcggtaatcctaccgtttacgggaccctaaaggggaccacggacttagggaacgtaaagttaaacgaacttggtaacggcctaggaccaactacgtccgtttacgtc

SEQ ID NO: 352834 - DNA, 656 bp, Homo sapiens
  misc_feature: GZ8MTXP02IPP40.22.73.G07.1.454.CMB.2.raw
  modified_base (198)..(198): a, c, t, g, unknown or other
  misc_feature (198)..(198): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgccaccctctcctgcgacgggccagtcaggagttgttagacaaactacttagtctaggtaccagcaagacgaccgtggccacggcctacccgaggcctcctcacttctagtgggtctccttcgtaccgagggtcctacgttcgggttacctcccccggacgtacggtttcacggtcgaccccgtagggtcggggtcgtggggacaggtcgttccacgttctaccacctntcacgcacgcngacagttcgtagtaacgttntttacgacttacttttattacgttagtactagtaactaaattataagttacgtacgtttcggtactacgtacttacccgtaccggttaccggaacgtaacggggtaactaacggtacgtaaagggaaacgttaaaacgttaaacgtaacggttaggtccggtacttacggacctacttacttacggttactttaccg

SEQ ID NO: 352835 - DNA, 552 bp, Homo sapiens
  misc_feature: GZ8MTXP02G2E3O.22.73.G07.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (420)..(420): a, c, t, g, unknown or other
  misc_feature (420)..(420): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagtctggtaccagcagagacctggccaggcctcccaggctcctnatctatggtncttctaccgnggccacgtcgggtactcccccgcctagggttccaggtgcccccgtaggttggggtactggggacaggtacgttccacttctaccacctatccagccagcctagcagtctagaatnttttgacttactttatacgtgtcagctaaatattaatgtacttggttactcgtattccgacgttcggaccaaagggccaggtacgtggaatacgttaaaacgcttggaacgctagacctacattctgttacc

SEQ ID NO: 352836 - DNA, 712 bp, Homo sapiens
  misc_feature: GZ8MTXP02HF9RX.22.73.G07.1.454.CMB.2.raw
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctccagataccactggagaatagtgatgacgcagtctccagccacctgtctgtgtctccgaggggaaagcgccacctctcctgcagggccagtcagagtgttagcaactacttgtctggtaccagcagagacctggccaggctcccgaggcctcctnatctatgggtcncttcaccgaggccctagtcggtacctccccgctaggttcaggtcgaccccgtaggtcggggtctggggaactaggtacgtttccaacgttcctaccgaacccgattccgaaagcctaacggtcccttaggaccgtacgttaccgttaagggtaaacgtttacgttttacgacccttttaaacttttaacttacgttggttaaccagtaacttaaatttaataagtcggttaacgttcggtttactaccggttacttacccggttaacccgtttcggaacccggtaaaacgggggtacctaaaccgggtaaccggttaagggtaaacgttaaaacgtttaaaaacccgggtacgtttacggggaacgggtaccttaacggacccttaaccggttactttaacccgtttaggtttacccc

SEQ ID NO: 352837 - DNA, 569 bp, Homo sapiens
  misc_feature: GZ8MTXP02HWKT2.22.73.G07.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (286)..(286): a, c, t, g, unknown or other
  misc_feature (286)..(286): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctntcctgcagggccagtcagagtgttagcaacacttagtctggtaccagcagagacctggccaggcctcccgaggcctcctnattctatgggtcgcttcctaccgagggcccacgtggtacctccccgctaggttcagtcgccccgtaggttcggggtctggggacaggtagtttccacttcctacaccctaatcgaagtcacgcctgcagtctagtaagtcttttgacttactttattactgtcagactaatataatgtactggttctagtactcgtacgttcgacgtaacgggacacggtactaggaaacgtaacgttaaaacgaacgtaggtcggtactacgactactacttcgttcgttcc

SEQ ID NO: 352838 - DNA, 693 bp, Homo sapiens
  misc_feature: GZ8MTXP02FFTK3.22.73.G07.1.454.CMB.2.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctgggccagggcccctaccgacgtcctccatattctagtgggtctccttacaccggaggtacctacggtcggtaccctccccggacgttacggtcacggttcgaccccggtaggggttcgggtacggtcggggaactaggttacgttccaccttctaccaccatcgaacgcaccgtcctagaccgtagtcgtaagggtaaacttgtttcgtaaccttttactttacttacgttactaccgaaagtactaaagttaataaacgtcggttaaccgtttcggtttaccgacgttactacccgttaccgggttacggaaccgggtaaaacggaccgaacggttaacggaagggtaaacgttaaaacgttaaaacccgaacggtttaggccgggtacttaccggacctaacccgtttacgttccgtttacgtttacc

SEQ ID NO: 352839 - DNA, 551 bp, Homo sapiens
  misc_feature: GZ8MTXP02GCLYY.22.73.G07.1.454.CMB.2.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (408)..(408): a, c, t, g, unknown or other
  misc_feature (408)..(408): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaacacttagtctggtaccagcagagacctggccaggcctcccaggcctcctcatctatggtncttctaccgagggccacgtggtactcccccgctaggttcagtcgccccaggtcgggtctggggacaggtacgttccacttctcacctatcagcacgcctgcagtctagagtnttttgcttactttatactgtcagtctaatataatgtacttggttctcgtactctaccgttcggaccgtaacggacacgtacgtaggaacgtaacttaaacgacgttaggtcggtactcgacctaccgtacttctacgtttacc

SEQ ID NO: 352840 - DNA, 529 bp, Homo sapiens
  misc_feature: GZ8MTXP02IEBOC.22.73.G07.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatgtgatgacgcagtctccagccacctgtctgtgtctccgaggggaaangccaccctntcctgcagggccagtcagagtgtagcaacactttagctggtaccagcagngacctggccaggcctcccaggctcctnatctatggtncttcaccngggccatggactcccgcaggttcagtcgcccagtgggtcnggggacngnttcactctcaccntcgancacgtcctgcagtctagaagtattttgactactttatactagtcagactaatataatgtactggttctcgtattcaccgttcggaccaagggtacacggacttagggaaactaagttaaaacgacttggtaacggtactacggaccaacgtctacgttcgtcc

SEQ ID NO: 352841 - DNA, 568 bp, Homo sapiens
  misc_feature: GZ8MTXP02FR5PP.22.73.G07.1.454.CMB.2.raw
  modified_base (197)..(197): a, c, t, g, unknown or other
  misc_feature (197)..(197): n is a, c, g, or t
  modified_base (421)..(421): a, c, t, g, unknown or other
  misc_feature (421)..(421): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacacttagtctggtaccagcagagacctggccaggcctcccgaggcctcccgtcatcctagtggtgcttcgtaccgaggggcccacgtcgggtactcccccggctagggttccaggtcgccccgtaggtgggtctggggacaggtacgttcactctcaccatcagcacgcctgcagtctgaaagtnttttcgacttactttattactgtcagcaatataatgtactggttctacgtactccgtacgttcggaccgaaacgggcacggtacgtagggaaataacgttaaaacgacgttggtaacggctacggaccaccgtacttctagtttccc

SEQ ID NO: 352842 - DNA, 744 bp, Homo sapiens
  misc_feature: GZ8MTXP02JTWTT.22.73.G07.1.454.CMB.2.raw
  modified_base (294)..(294): a, c, t, g, unknown or other
  misc_feature (294)..(294): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagcgcccaccctctcctgcgacgggccagtcagagtgttagcaactacttagtctggtaccagcagacgaccgtggccaggcctcccgaggcctcctanacttctagtcggtcgtccttaccgtaccgacgggccctacgtcgggtacctcccccgcgtaggttcaggtcgccccgtaggtcgggtctaggggactaggtacgttccacgtctaccaccgtactacgacgcacgtcctgaccgtagtcgtaggtaagtttacgtttttacgacctttaacttttacgttacgtttcggtaactaacgttaactaaaatttaacgttaaagttccggttaaaccgtttcggtttaccgttaccggtaactttaccccgttaccggttacccggggaaacccggtaaaacggggtaaccctaaccggggtaaacgttaacgggggtaaaccgtttaaaacgtttaaaaccgggtaaacgtttcggggtaaccggtacccgttacggtaacccctaaaccgtttacgtttcccggtttacgttttacccccg

SEQ ID NO: 352843 - DNA, 544 bp, Homo sapiens
  misc_feature: GZ8MTXP02F6ZDM.22.73.G07.1.454.CMB.2.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (410)..(410): a, c, t, g, unknown or other
  misc_feature (410)..(410): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagtctggtaccagcagagacctggccaggcctcccaggcctcctcatctatggtncttcaccgagggccagtcggtactcccccggcaggttcaggtcgccccgtaggtggggtctggggacaggtagttccactctccacctatcagcacgcctgcagtctgaagttnttttcgacttactttattactgtcagactaatatatgtacgttgttctgtactcctaccgttcggaccgaacgggacacgacgtaggaactaaacgttaaacgacgtggcggtctacgccacgtactctcgttc

SEQ ID NO: 352844 - DNA, 584 bp, Homo sapiens
  misc_feature: GZ8MTXP02IRRXH.22.73.G07.1.454.CMB.2.raw
  modified_base (197)..(197): a, c, t, g, unknown or other
  misc_feature (197)..(197): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtcctcgaaggggaancgccaccctctcctgcgacgggccagtcaggtagttgttagacaactaacttagtctacggtaccagcagacgcgtggccacggcctcccgaggtcctcctcactcgtagtggtctcttacgaccgacgggcctacgtcggtacctccccgacgtaggttccaggtcgccgtagggtcggtcgtggactaggtacttcgacctcaccaccnctcgacgacacgtccngctacgtntagtagttacgtttcgtacttactttattacttagtactagtactaattatagtgtacgttgttactcgtactctaccgtcgaccgacggacacggacgtacggaataacgtaaaacgtgtaggtcgtacgtcgactacctctacttcgttc

SEQ ID NO: 352845 - DNA, 638 bp, Homo sapiens
  misc_feature: GZ8MTXP02I2EDN.22.73.G07.1.454.CMB.2.raw
  modified_base (197)..(197): a, c, t, g, unknown or other
  misc_feature (197)..(197): n is a, c, g, or t
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggaagaaatagtgatgacgcagtctccagccacctgtctgtgtctccgaggggaaangccaccctctcctgcgagggccagtcagagtgtagctaaacaacttgctggtaccagcagacgacctggccaggcctcccgaggcctcctcatcgtagtgggttctcctttaccgtaccgaggggtcccctacgttcgggtaccctcccccggacgtagggttccaggtcgaccccgtagggttcggggtctaggggactaggtcgttccactctaccaacctntcaggcacgcctgcagtctagtaagttntttacgacttaatttatactagtcagactaataactatcgtacgttcggttctacgtaacttccgtaaccgttcgggaacccgtaaacggggacctaaacgggtaaccgtagggtaaacgttaaacgttaaaaaccgtacgttaggttcggacttacggaccctaccgttaacttcgtttacgtttccg

SEQ ID NO: 352846 - DNA, 536 bp, Homo sapiens
  misc_feature: GZ8MTXP02GSRWK.22.73.G07.1.454.CMB.2.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (377)..(377): a, c, t, g, unknown or other
  misc_feature (377)..(377): n is a, c, g, or t
  modified_base (423)..(423): a, c, t, g, unknown or other
  misc_feature (423)..(423): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcaactaacttagtctggtaccagcagagacctggccaggctcccaggcctcctcatctatggtnctttcaccagggccactgggtactccccgctaggttcagtgcccctaggtgggtctggggacaggtagttcactctacaccntcagcacgcctgcagtctgaagtattttgactatttatactgtcanacaatataatagtacgttggttctcgtactactaccgttcgtaccgaacggacgacgacgtaggtaagtaacgttaaacgaacgtagtaagtcgtacgacactactctcttcc

SEQ ID NO: 352847 - DNA, 625 bp, Homo sapiens
  misc_feature: GZ8MTXP02JORCK.22.73.G07.1.454.CMB.2.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (269)..(269): a, c, t, g, unknown or other
  misc_feature (269)..(269): n is a, c, g, or t
tcagacatacgcgtcacgaccggtgctcgatttagctctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcactgccggnaagtcagagcaataacgtactatttaaatggtatcagcaagaaaccaggaaacncccctaagctcctgatctatgctacttccagtttgactaaaggtcggggttacctgtaaaggttcagtggacaggtgactcgtggggaactagtactttacgcttacctccaacgtacgtcccggtaccggttctacggactaacccgtagaacgtatttaccgactaaacctttacacttcgtacaactacgtacttacgacgtacccgacccccgtatacccgtaccgttaccggaccgaaacgggaccctaacggtaccgtacgggtaaacgtaaacgtttaaaaaccggacgttcggtacgggtaccttaacggaacccacctacttaccggttaccgttctacctttaccg

SEQ ID NO: 352848 - DNA, 572 bp, Homo sapiens
  misc_feature: GZ8MTXP02F2MSM.22.73.G07.1.454.CMB.2.raw
  modified_base (198)..(198): a, c, t, g, unknown or other
  misc_feature (198)..(198): n is a, c, g, or t
  modified_base (441)..(441): a, c, t, g, unknown or other
  misc_feature (441)..(441): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccacctctcctgcagggccagtcagagtgttagcaaactaacttgtctggtaccagcagacgacctggccaggcctccccgaggcctcctcattctagtgggtctcctttccaacccgagggccctacgtcggtacctcccccggctaggttcaggtcgccccgtaggtcggggtctaggggactaggtacgtttccaccttcctacaacccatcgagccacgcctgctagtctagaattntttcgacttatttatctgtacagtactaaattataagtgtacgttggttctacgtactccgtaccgttcggaccaagggacacggtacgtaggaactaacgtaaacgtgtaggcgcgtcacactatctgtc

SEQ ID NO: 352849 - DNA, 703 bp, Homo sapiens
  misc_feature: GZ8MTXP02IEDI7.22.73.G07.1.454.CMB.2.raw
  modified_base (437)..(437): a, c, t, g, unknown or other
  misc_feature (437)..(437): n is a, c, g, or t
  modified_base (542)..(542): a, c, t, g, unknown or other
  misc_feature (542)..(542): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtcgtcgtaccgaaggggaaacgacgccctacccctctccgtgacgacgggccagtcaaggtagtgttaacgactaaacgtaacgttagtcgtagggtaacccaagcgaacgacgacccgtaggaccccagggcccctaccccgaggtccttcccctatactcgttaggtggtcctaccttccaaccggacggccctacggttaccggtacctcccccgacgtaggttcacggtcgaccccgtagggtcgggtacgngggaatcggtacttccaccgttcaccacgtaactcaacgtccacgtccgtgaccgtagtcgtagtaacgtttagtttcgacttaaccttttacgtacgtcgttanaaagtacttaaagttaattagtacgttacgttaggttacctacgtacgttacccgtaccggtaccggaaaaccgtacggggtaaccctagggaacgtaagggaaacttaaacgttaaacgtacgtaggtaacgacctcgacctaacgttccgtcttactcc

SEQ ID NO: 352850 - DNA, 607 bp, Homo sapiens
  misc_feature: GZ8MTXP02FHTTD.22.73.G07.1.454.CMB.2.raw
  modified_base (199)..(199): a, c, t, g, unknown or other
  misc_feature (199)..(199): n is a, c, g, or t
  modified_base (293)..(293): a, c, t, g, unknown or other
  misc_feature (293)..(293): n is a, c, g, or t
  modified_base (410)..(410): a, c, t, g, unknown or other
  misc_feature (410)..(410): n is a, c, g, or t
  modified_base (440)..(440): a, c, t, g, unknown or other
  misc_feature (440)..(440): n is a, c, g, or t
  modified_base (469)..(469): a, c, t, g, unknown or other
  misc_feature (469)..(469): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggaagaaatagtgatgacgcagtctccagcccaccctgtctgtgtctccgaggggaaanagccacccctctcctgcagggccagtcagagtgttagcaactaacttgtctggtaccagcagagacctggccagggcctccccaggcctacctnatctatggtcgccttctaccgaggggcccaacgttcgggtacctcccccggtacctagggttcaggtcgccccgtaggtcggggtctggggacaggacgtttcacttctacaccctntcagcacgcctgctagtcgtagtaaagttntttacgactttaactttattactgtacanactaaatataatgtacttgtctacgtactcctaccgtcggaccgtaacgggacctacggtaacgtagggtaaactaaacgtttaaaccggaagttacggtaaggcgttacgaccctacctactccggttcgtttaccc

SEQ ID NO: 352851 - DNA, 703 bp, Homo sapiens
  misc_feature: GZ8MTXP02HM3OW.22.73.G07.1.454.CMB.2.raw
  modified_base (197)..(197): a, c, t, g, unknown or other
  misc_feature (197)..(197): n is a, c, g, or t
  modified_base (466)..(466): a, c, t, g, unknown or other
  misc_feature (466)..(466): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagttgttagacaacattagtctggtaccagcagacgacctggccaggcctcccgaggcctcctacattctagtcgggtctccttacctaccgaggggccctacgttcgggttaaccctcccccggacgtacggttccaggttcgaccccgtagggtcggggtctacggggactaggtacttcgactctaccaccctagtcacggcctacgcctacgactaggttctaaggtaaacgtttnttttacgacttttaactttactacgttagtaccgtaaagtataaaattagttaagttagtaacgtttcgggtttacctacggttaaccttacccgtaacccggttaccgggaacccgtaaaacggggtaccgtaaaccggtaaccggttaagggaaaccggttaaactaaaaaccgggttccgttaagggtcggtacgttaacggaccctacgtaaccttacggtttacgtttcccg

SEQ ID NO: 352852 - DNA, 625 bp, Homo sapiens
  misc_feature: GZ8MTXP02JK2WZ.22.73.G07.1.454.CMB.2.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcaggagtgttagcaacaacttagtctggtaccagcagacgacctggccctaggcctcccgaggcctacctnaatctacgtggttcgacttctaaccgcggggtcctacgttgggtacctcccccggctaagggtttccaaggttcgacccccgtaggtcggggtacgtacggggactaaggacgtttcaccgtctacaccgattcggatcagcctgcagtctagtaatattttgactacgtttattacctagttccagactaattataaacgtagtaactggtttacgacgtacttaccgtaccgtttacgggacccgtaaacgggtacaacggtaaccgtgggaaacgtaacgttaaaacgcgttagttaacggcttacggaccacgtacttcgtaacgtttccg

SEQ ID NO: 352853 - DNA, 498 bp, Homo sapiens
  misc_feature: GZ8MTXP01C0U1J.10.9.A09.1.454.CMB.2.raw
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
tcagcatagtagtgcacgaccggtgctcgatttagcgagacgcgcaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaagagccaccctctcctgcagggccagtcagatgtgcnctgancngacanacaactgcagctccagccctnatctatggtncatccaacgagggccactggcatccccagccaggttcagtcggcaggtgggtatgggaacagcttcactctcaccatcatcagcctggagcctagaagtatgttgctagtttattactgtacaactatcgtacgagtcggccgtccggggcctacgttccggcctcgggaccaagtggagattcgaaacgacttgttgctgcaacatcttgtcttctaac

SEQ ID NO: 352854 - DNA, 530 bp, Homo sapiens
  misc_feature: GZ8MTXP01EM8E0.10.9.A09.1.454.CMB.2.raw
  modified_base (203)..(203): a, c, t, g, unknown or other
  misc_feature (203)..(203): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagcccaccctgtctttgtctccaggggaaanagccaccctctcctgcagggccagtcagaatgttggcgccttgaagctggtaccaacacaaactggcaggctcccagccctnatctatggtncatccaacnggccactggcatcccagccaggttcagtgcagtgggtatgggaacagcttcactctcaccatcatcagcctggagcctgaagatgttgctagttattactgtacaactatacgtaccgagtcggccgtccgggggcctacgtttccggcccgttagggacccaaaggtcggaaagacgttacgaaacgaacttggttgggctggcaacatcttgtaacttcgtaac

SEQ ID NO: 352855 - DNA, 536 bp, Homo sapiens
  misc_feature: GZ8MTXP01CAVSO.10.9.A09.1.454.CMB.2.raw
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (375)..(375): a, c, t, g, unknown or other
  misc_feature (375)..(375): n is a, c, g, or t
  modified_base (529)..(529): a, c, t, g, unknown or other
  misc_feature (529)..(529): n is a, c, g, or t
tcagcatagtagtgcacgaccggtgctcgatttagcgagacgcgcagggggaggaactactcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttgcgcttcgtaagctggtaccaanacaaactggccaggcctccaggcccctnatctatggtgcatcccaacacggggccactggcactccccagccaggttcagtggccaggtgggtatgggacaagcttcactctcacntcatcagctggagcctgaagagtgttgctagtttattactgtacaacgtattcgtaccgaggtcggcccgtccgggggcctacgtttccggcccgtgggaccaaggtggagatacgaaacgaacgtggcggcttcgcacctgtctcgttcttcncttcccg

SEQ ID NO: 352856 - DNA, 568 bp, Homo sapiens
  misc_feature: GZ8MTXP01DKV96.10.9.A09.1.454.CMB.2.raw
  modified_base (232)..(232): a, c, t, g, unknown or other
  misc_feature (232)..(232): n is a, c, g, or t
  modified_base (317)..(317): a, c, t, g, unknown or other
  misc_feature (317)..(317): n is a, c, g, or t
  modified_base (370)..(370): a, c, t, g, unknown or other
  misc_feature (370)..(370): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggagcgtagtccagcctgggagtcanagagactctctgtgcagcctgtggttcaccttcagtagctacggcatgcacgtcgggtacccaccaaactccgaggcaaaggggnttgggagtgggtgctagttgttcatctggagggctagtgttacaaagttggtntgctggaccgccgtaggaagggcccattcacatctacagagacaactccaagaacacatgtagttggacctagaacacgcctaagtccgtaggacgacgtacgggtataactaactacgttaggtaaacggaaggggaacggggaacaggcgggttacgtaaccaagttcctccgttgaccgtcggcggggtaacccg

SEQ ID NO: 352857 - DNA, 553 bp, Homo sapiens
  misc_feature: GZ8MTXP01CTNOW.10.9.A09.1.454.CMB.2.raw
  modified_base (397)..(397): a, c, t, g, unknown or other
  misc_feature (397)..(397): n is a, c, g, or t
  modified_base (536)..(536): a, c, t, g, unknown or other
  misc_feature (536)..(536): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccagggaaagagccaccctctcctgcagggccagtcagaatgttggcgccttcgtaagctggtaccaacacaaacctggccaggctcccaggcccctcatctatggtgcatcccaacgaggggcccacgtggccatccccagcccaggttcagtcggcaggtgggtatggggaacagcttcactctcaccatcatcagcctggacncctagaagtatgttgcttagtttattactgtacaaactagttccgtaaccggagtcggcccgttccgggggccctacgtttccgggcccgtggggaaccaaaggtggagacttacgaaacgacttgttggctgcaaccntcttacgtcttcgtaac

SEQ ID NO: 352858 - DNA, 578 bp, Homo sapiens
  misc_feature: GZ8MTXP01BBAT8.10.9.A09.1.454.CMB.2.raw
  modified_base (374)..(374): a, c, t, g, unknown or other
  misc_feature (374)..(374): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggagtcacagagactctcctgtgcagcctcgtgggttcaccttcagtagctacggcatgcacgtcgggtcccaccaaactccgaggccaaaggggattgggagtgggggtggctagtttgttcatctggagggctaggtgttcaaagtggtntgctgacgccgtagaacgggccgattcaccatctacagagacaactccaagaacacaatgtagtttcggactgaacagacctaagtccgtagacggtaccgacgggtagtataactacgttggtaacggaaggggacgggggaacagggcgggacgttaaccgaagtaaccgttccgttggaccggtcgttcggggtaacccgg

SEQ ID NO: 352859 - DNA, 824 bp, Homo sapiens
  misc_feature: GZ8MTXP01DOAOH.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagccgtgggagtcacagagactctcctgtgcagcctcgtggttcaccttcagtagctacggcatgcacgtcgggtcccaccaaactccgaggcgaaagggtattgggaggtgggtgctaggtttcgtttcagtcgtaggacggggtctaggttcgttacaaaagttgggttaatcggtccgttacgggaaccggtcccgggttaggggaaacgggggtcccgtacgtttacccgaacccgtaacttcccgttacccgaaaggtaaaccgaaaccctaaacccgttacccgaaacgggtaaaacccaaccgttaaaagtttacggtttaacgggttttaaccgggtaaacccgtttaaacggaaacccgtaaccggttaaccccgttaaacgggttaccccgtaagggtaacgggtaacccggtaacgggggttacttaaacgttaaaccgttaaccggttagggttaaacccgggaaaaggggggtaaacggggggaaacccgttaagggggttaccggggttaaacggtttaacccgtaaacgggtttaacccgtttacccggtttacgggttaccgggttccgggttccgggggtaaccccgg

SEQ ID NO: 352860 - DNA, 579 bp, Homo sapiens
  misc_feature: GZ8MTXP01BMMEQ.10.9.A09.1.454.CMB.2.raw
  modified_base (371)..(371): a, c, t, g, unknown or other
  misc_feature (371)..(371): n is a, c, g, or t
tcagcatagtagtgcacgaccggtgctcgatttagcgagacgcgcagggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagccgtgggagtcacagagactctcctgtgcagcctcgtgggttcaccttcagtagctacggcatgcacgtgggtcccaccaaactccgaggcaagggattgggaggtgggtgctagtttgttcatcgtggagggctagtgttcaaagttggtntgcgtgaccgtccgtaggaacgggtccgattcaccatctaccagagacaactcagaacaacaatcgtagtttcggactagaacacgctaagtcctagacggtacgacgggtgtataacgtacgttaggtaacgggaagggacgggggaaccagggcgggttacgtaaccgaagtccgttccgttggaccgtcgttcggggtaacccgg

SEQ ID NO: 352861 - DNA, 527 bp, Homo sapiens
  misc_feature: GZ8MTXP01AY6DI.10.9.A09.1.454.CMB.2.raw
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
tcagcatagtagtggcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcactggttccgccaaactccaggcaagggnttggagtgggtgcagttgttcatctgagggcagtgtcaaatggtntgctgacgcgtgaggcatcacntcncagacgacactcagacacatgtagttgactagaacagacctaagtcctagaggtacgacgggtgtataacgtacgttaggtacggaagggaacgggggaaccagggcgggagtaacgagtctcgttgacgtcgttggggtaaccg

SEQ ID NO: 352862 - DNA, 525 bp, Homo sapiens
  misc_feature: GZ8MTXP01EVWX4.10.9.A09.1.454.CMB.2.raw
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (266)..(267): a, c, t, g, unknown or other
  misc_feature (266)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccacctgtcttgtctcagggaangccaccctctcctgcagggccagtcagatgtgcncttgagctgacaacacaactgcagctccagccctnntntntgncancanggcagngcanccagcagtcagtcgnagtggtanggaacagtcttcactctcacntcatcagcgtggacnctagaagtntgtgacttagtttatactgtactaactagtaccgtacgtacgtcggcccggttccggggtcctaccggttccggacccgtacgggaaccgtaaggtcggaagtacgttaaacgaaacgtaacgttggttcgcgtgacctaactacgttcgttcgttccttaacgtcg

SEQ ID NO: 352863 - DNA, 797 bp, Homo sapiens
  misc_feature: GZ8MTXP01B73UZ.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggagcgtagtccagccgtgggaggtcacagagactctcctgtgcagcctcgtgggttcaccttcagtagctacggcatgcacgtgggtcccaccaaactccaggcaaagggtattgggaggtggggtgctagtttgttcatcgtggagggctaggttgttacaaaagttgggtaatcggacgttcggaaccggtcccggtagggaaacggggcccgtagttaccaacctactcctacccgaagaacgaaccaacctaccgaaacgggtaaaccaactaaattacggtttaacggttttacggggtaacccgttaacggaaaacccgtaacggtaaccccgttaaaacggttccccgttaacgggtaaccgggtaaacccgggtaaccgggggttaaggtttaaaccgttaaaccggttaaaccggttaaggggttaaaacccgggggaaaagggggtaaacgggggggggaaaacccgttaacgggggaccgggggttaaaccggtttaacccggtaaaacgggtttaacccgtttaccccggtttacggttacccggggttaaccggttaaccggggggtaaccccgggg

SEQ ID NO: 352864 - DNA, 531 bp, Homo sapiens
  misc_feature: GZ8MTXP01DOYOP.10.9.A09.1.454.CMB.2.raw
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
  modified_base (452)..(452): a, c, t, g, unknown or other
  misc_feature (452)..(452): n is a, c, g, or t
tcagcatagtagtgcacgaccggtgctcgatttagcgagacgcgcagggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtccnccaaactccaggcaagggattggagtgggnggcagtttgttcatctgagggcagtgttcaaatggtntgctgacgccgtagaagggccgattcacatctccagagacaactccagacacaatgtagttgacctgaacagcctaagcctagagtacacgggtntagtaactacttggtacgaagggagggggaaccaggcgggagtccgaagtcgtccgttagacgtcgttcggggtaaccg

SEQ ID NO: 352865 - DNA, 596 bp, Homo sapiens
  misc_feature: GZ8MTXP01EU7OX.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctggggagtcacagagactctcctgtgcagcctctgggttcaccttcagtagctacggcatgcacgtcgggtcccaccaaactccgaggcaagggattgggagtggggtggctagtttgttcagtcgtggagggtcaggtgttacaaagttggtaatgctggacgtccggtaggaaacgggcccgtattcaccatcctaccagaacgacaactccgaagaacacaatgtagttcggactagaacacgacctaagtcctaggacggtacgtacgggtagtataactacgttaggtaacggaaaggggacgggggaacacgggcgggttacgttaaccgaagttaaccgttcgttggacgtcggttcggggtaaccgg

SEQ ID NO: 352866 - DNA, 570 bp, Homo sapiens
  misc_feature: GZ8MTXP01CUHKH.10.9.A09.1.454.CMB.2.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (549)..(549): a, c, t, g, unknown or other
  misc_feature (549)..(549): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagacgccaccctctcctgcagggccagtcagaatgttggcgtccttgtaagctggtaccaacacaaacctgccaggctcccagccctnatctatggtncatcaacnggccatgcactccagccaggtcagtcggcaggtggtatgggaaacagcttcactctccaacatacatcagcctagggacncctagaagtnttgtnacttatttatactgtacaacgtagttaccgacgaggtccggtcccggtccggggtacccttacggttcccgggacccgtacgggaaacctaaggtcggaacgtaacgttaaccgaaacgtcgttggttcggctcgaccaaccgttntccgttgtttcccttcgtaac

SEQ ID NO: 352867 - DNA, 639 bp, Homo sapiens
  misc_feature: GZ8MTXP01BNY08.10.9.A09.1.454.CMB.2.raw
  modified_base (201)..(201): a, c, t, g, unknown or other
  misc_feature (201)..(201): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccagggaaangccaccctctcctgcagggccagtcagaatgttggcgccttgaagctggtaccaacacaaacctggccaggctcccaggcccctcatctatggtgcatcccaacggcgactcgtcgactaccctaccgaccgacggttacgtacgtagggtccgacggtaggggtaggttacgggacggaaacgacgttcctaccgtaccttcctacccactactactactacgactccggtaggaccgttcgaagaaacgtgtttggtctaacgtttagtttaacttcgttctaaacgaacttacgtaccgtaacggtggtcccgtcccggggtccggacctttccggtcccgtccgggtaacgaaaccggtaaggtacggactacgaaccgaaacgtacgttgggttacgcgtccgacaacgttctcgttcttccttaagttcccg

SEQ ID NO: 352868 - DNA, 511 bp, Homo sapiens
  misc_feature: GZ8MTXP01DR2PC.10.9.A09.1.454.CMB.2.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (494)..(494): a, c, t, g, unknown or other
  misc_feature (494)..(494): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagcccaccctgtctttgtctccaggggaaanagccaccctctcctgcagggccagtcagatgtgcnctganctgacananaactgcagctccagccctnatctatggncatccaacagggccactggcatcccagccaggttcagtcggcagtgggtatgggaacagcttcactctcaccatcatcagcctggagcctagaagatgttgctagtttattactgttacaacattacgtaccgagtcggcccgttccgggggcctacgtttccggcccgtgggaacccaaaggtggagattacgaaacgacttgttggctgacnccatcttgtcttctaac

SEQ ID NO: 352869 - DNA, 570 bp, Homo sapiens
  misc_feature: GZ8MTXP01EHU67.10.9.A09.1.454.CMB.2.raw
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccacctgtctttgtctccgaggggaanagccaccctctcctgcagggccagtcagaatgttgcgcttgaanctgacaanacaactggcaggctccagccctnatcatggngcatccaacngggccactggcatcccagcccaggttcaggtcgcagtgggtatgggaacagcttcactctcaaccntcatcagcctggacnctagaagtatgttgactagtttaacttatgttacaaactagttcgtaccggaggtcggtcccggtccgggggtcctaccgtttcgggacccttggggaaaccctaaaagggttcgggaagtagttaacccgaaaaggtaaaccgttgggttacggacttggaccgaaccctattccgtttacgttccgttcgtcc

SEQ ID NO: 352870 - DNA, 640 bp, Homo sapiens
  misc_feature: GZ8MTXP01CXANF.10.9.A09.1.454.CMB.2.raw
  modified_base (250)..(250): a, c, t, g, unknown or other
  misc_feature (250)..(250): n is a, c, g, or t
  modified_base (319)..(319): a, c, t, g, unknown or other
  misc_feature (319)..(319): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaacgtggtggagtcgtgggggagcgtagtccagccgtgggagtcacagagactctcctgtncagcctgtgggttcacttcagtgctacggcatgcacgtcgggtcccaccaaactccgaaggcgaagggnttgggagtgggtgctagttgttcatcgtcggagggctaggtcgttacaaaagttgggtaatgcgtggaccggccggtaggaaacgggccctagttccacctatccgtaccaagaacgacaacctacgaacgaaaccaataagtacgttaagttcggaaccttagaaacacgtaccctaagtccctaggacgtacgtacggtgtaagtaaccgtaagttagggtaaacggaaggggaacgggggaaccacgggttcgggttaacgttaaccgaaagttaaccgttaccggttacggaccggttccggttcgggggtaacccg

SEQ ID NO: 352871 - DNA, 720 bp, Homo sapiens
  misc_feature: GZ8MTXP01BGQLF.10.9.A09.1.454.CMB.2.raw
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggagcgtagtccagcctgggagtcacagagactctcctgtgcagcctcgtgggttcaccttcagtagctacggcatgctacgtgggtcccgaccaaactccgaggacaaggggatttgggaggtggggtgctagtttgttcagtcgtggagggntaggtgttcaaaagttggtntgctagggaccgtccggtaggaacggggtccctacttccaccagtcctaccgaagacgaaccaaccgtaccgaacggaaaccaactaaagttacggttaagtttacgggaacccgttacgaaaccgtacgtacccgttaaacgtcccgttagggaacggtaaccggtaacggggttacgttaaacgttaaccgttaacggttacgggtaaacggggaaacgggggaacgggggggtaaacccgaacgggggttcggggttaacggtttaacccggtaacggttaacccgtttaccggtttacggttacccggggttcggttaaccggggggtaaccccgg

SEQ ID NO: 352872 - DNA, 582 bp, Homo sapiens
  misc_feature: GZ8MTXP01A2V0X.10.9.A09.1.454.CMB.2.raw
  modified_base (379)..(379): a, c, t, g, unknown or other
  misc_feature (379)..(379): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtcgggtcccgaccaaactccgaggcaaggggattgggagtgggggtggctaggtttgtttcagtctggaggggctaggtgttcaaagttgggtntgctgacgcgtgacgggcatcacatctcagagacaactccagaacacaatgtagtttaggacctagaacagacctaagtccgtaggacggtacgtacgggtagtataactacgttaggtaacgggaaggggaacggggggaaccagggcgggttacgttaaccgaggttaaccgtccgttggacgtcgttcggggtaacccgg

SEQ ID NO: 352873 - DNA, 609 bp, Homo sapiens
  misc_feature: GZ8MTXP01DQOGT.10.9.A09.1.454.CMB.2.raw
  modified_base (323)..(323): a, c, t, g, unknown or other
  misc_feature (323)..(323): n is a, c, g, or t
  modified_base (423)..(423): a, c, t, g, unknown or other
  misc_feature (423)..(423): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggagtcacagagactctcctgtgcacgtcctcgtgggttccaccttcgagtagctacggcatcgctacgtgggtcccaccaaactccgaggacaagggtntgggaggtgggtgctaggttgtttcatcgtggagggtctaggttgttacaaagttggtaatgctaggaccgtcggtaggaacgggtccgtattccacctntcctccaagacgacaactcgaagaacactatagtagttcggactagaacgtataccgtaagtccgtaaggacggtacgtacgggtactagtaacgtacgttaggtaacgggaaagggtacgggggaacacgggttcggttagttaacccgaagttccttcgttggacgttcggttcgggtaacccg

SEQ ID NO: 352874 - DNA, 789 bp, Homo sapiens
  misc_feature: GZ8MTXP01DDBSP.10.9.A09.1.454.CMB.2.raw
  modified_base (328)..(328): a, c, t, g, unknown or other
  misc_feature (328)..(328): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggagcgtagtccagccgtgggaggtcacagagactctcctgtgcacgtcctcgtcgggttccaccttcagtacgctacggcatgccacgtcgggtcccaccaaactccgaggcgaaagggtnttgggaggtggggtgctagtttgtttacatcgtggacgggctagttgttacaaagttggtaatgcgtggaccggccggtagggaacggggtcccgtacttccgaacctactccgtacccgaagaacgaaccctaaaccgtacccgaaacgggtaaaccaaaccgtaaagttacggtttaacggtttacgggtaacccgttaacggaaacccgtaacggtaaccccgttaaacggttcccgttaacgggaacgggtaaccggtaaccgggggttacttaaacgttaaaccgttaacggttaacggggttaaaccggggaaaggggggtaaaccgggggggaacccgttaaacgggggttccgggggttaaaccggtttaaccccgtaaaacgggtttaaccccgtttaccggtttaccgggttaacccgggtttccggggttcccggggggttaaccccggg

SEQ ID NO: 352875 - DNA, 602 bp, Homo sapiens
  misc_feature: GZ8MTXP01E0Y2R.10.9.A09.1.454.CMB.2.raw
  modified_base (255)..(255): a, c, t, g, unknown or other
  misc_feature (255)..(255): n is a, c, g, or t
  modified_base (405)..(406): a, c, t, g, unknown or other
  misc_feature (405)..(406): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
tcagcatagtagtgcacgaccggtgctcgatttagcgagacgcgcagggggggagaggagcccagcactagaagtcggcggtgtttccattcggtgatcaacactgaacacagaggactcaccatggagtctgggctgaacttgggttttcctcgttgcttcttttaagaggtgtccagtgtcaagtgcaactggtggagtcgtgggggagcgtagtccagcctgggagtcacagagactctcctgtgcagcctntgggttcaccttcagtagctacggcatgcactcgggtcccaccaaactccgaggcgaaggggattgggaggtggggtggctaggtttgtttcatcgtggacgggctagtgttcaagtgggtatgctgaccgcgtagaagggcctatcacnncncaganacactcagaacacaatgtatttcggggactagaacacgacctaagtccgtaggacggacgtacgggtagtaactacgtaacgtaggttaaacgggaaaggggaacggggggaaaccgagggacggggttacgttaccgtaaagttaccgttcccgtttggacggttcggtaacggggccgtaaccgggg

SEQ ID NO: 352876 - DNA, 496 bp, Homo sapiens
  misc_feature: GZ8MTXP01BRLTY.10.9.A09.1.454.CMB.2.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (321)..(321): a, c, t, g, unknown or other
  misc_feature (321)..(321): n is a, c, g, or t
  modified_base (358)..(358): a, c, t, g, unknown or other
  misc_feature (358)..(358): n is a, c, g, or t
  modified_base (482)..(482): a, c, t, g, unknown or other
  misc_feature (482)..(482): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccacctgtcttgtctccgagggaangccacctctcctgcagggccagtcagatgtgcncttganctgacancaacnggcagcnccagccctnatcatgncancaacnggccatggcatccagccaggttcagtcggcaggtgggtangggaacagtcttcactctcaccatcatcagcctggcnctgaagtattgtgactagttatactgtacaactgtccgacgtagtcgcccgtccggggtcctacgttccggccgtacgggaccaaggtcggagtacttacgaaacgattcggcgctcgcaacgntcttgtcttctaac

SEQ ID NO: 352877 - DNA, 641 bp, Homo sapiens
  misc_feature: GZ8MTXP01B1HFH.10.9.A09.1.454.CMB.2.raw
  modified_base (206)..(206): a, c, t, g, unknown or other
  misc_feature (206)..(206): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
tcagcatagtagtgcacgaccggtgctcgatttagcgagacgcgcagggggaggaactctcagttaggacccagagggaaccatggaagccccagctcagcttctcttcctcctgctactctggctcccagtttcagataccaccggagagattgtgttgacacagtctccagcccaccctgttctttgtctccgaaggggaaagngcccaccctctcctgcagggccagtcagaatggttgcgtccttcgaagctaggtaccaacacaaacctggccaggcctcccaggcccctnatctatggtncactccgaacgcgggcccacgtggccatcccagccaggttcaggtggcctaggtgggtatgggacaagactttcactcctcaccctatcatccagccgtgggacgcctaggaagtagttgttcgtcgttagtttattacttagtactaaacgtacgttaccggttaaccggacggttccgggtccccggttcccggggggtacccttacccgggttttcccgggtaccccggttacggggtaaacccgtaaagggtaacggtaagttacgtaaccgaaacgtaacgtggttacggcgttcggcctaccgtcgttctcgttccttcttcgttcccg

SEQ ID NO: 352878 - DNA, 699 bp, Homo sapiens
  misc_feature: GZ8MTXP01DUXRX.10.9.A09.1.454.CMB.2.raw
  modified_base (326)..(326): a, c, t, g, unknown or other
  misc_feature (326)..(326): n is a, c, g, or t
tcagcatagtagtgcacgaccggtgctcgatttagcgagacgcgcgagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagccgtgggagtcacagagactctcctgtgcagtcctcgtcgggttcaccttcagtagctacggcatgcacgtcgggtcccaccaaactccgaggacgaaagggtnttgggaggtgggtggctagtttgtttcagtcgtggaggctagtgttacgaaaagttggtaatgctggacgtccggtaggaacgggtcctagttcacctatcctaccgaagaacgactaactaccgaaggaaacaactaaagttagttaacgtttacggaaccttagaaaccgtacgtaacccgttaacgtacccgtaggtaacggtaaccgtaaccggggttagttaacgtaaccgttaacggttacgggttaaacgggaaagggggtaaacggggggaaaccgacggggttacggggttaaccgttaaccggtaaacggttaacccgtttaccggttacggttaccgggttcggttcgggggtaaccccggg

SEQ ID NO: 352879 - DNA, 650 bp, Homo sapiens
  misc_feature: GZ8MTXP01CZOOK.10.9.A09.1.454.CMB.2.raw
tcagcatagtagtgcacgaccggtgctcgatttagcgagacgcgcaggggggggagaggagcccagcactagaagtcggcggtgtttccattcggtgatcaacactgaacacagaggactcaccatggagtctgggctgaacttgggttttcctcgttgcttcttttaagaggtgtccagtgtcaagtgcaactggtggagtcgtggggggagcgtagtccagccgtgggagtcacagagactctcctgtgcagcctctggttcaccttcagtagctacggcatgcacgtcgggtccacccaaaacctccgaaggacgaagggtagttagggaggtgggggtggctaggtttgtttcatcgtggacggctagtgttacaagtgggtatgcgtggacgccggtaggaacgggctatcacatctcagacgaacaactacaaggaacaactaatacgtagttcgggaactagaacacgtacctaacgtccgtaggaacgacggtacgggtagtaactaaccgtaacgtacgggttaacgggtaaagggggaacgggggtaaaccggagggttaccggggttacgttaccggtaaacgttacccgttccgtttacgggaccggttacggtccgggggaacccggtaacccgggg

SEQ ID NO: 352880 - DNA, 754 bp, Homo sapiens
  misc_feature: GZ8MTXP01EER5X.10.9.A09.1.454.CMB.2.raw
tcagcatagtagtgcacgaccggtgctcgatttagcgagacgcgcgagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagcctgggagtcacagagactctcctgtgcagtcctcgtgggttcaccttcagtagctacggcatgcacgtcgggtcccaccaaactccgaggcaaagggtattgggagtggggtgctaggtttgttcatcgtggagggtctaggttgttacaaaagttgggttaatggtaccgttagggaaccggtcccgggtaagggaaacggggtcccgtaactttccgaacctactacctaccgaagaacgaacctaaaccgtaccgaaacggaaacccaactaaacgtttggtttaaacggtttacgggaacccgttaaggaaaccgaacggtacccgttaaacgtcccgtaaggaacgggtaaccgtacggggttaagttaacgttaaacgttaaacggttacgggtaaaccgggaaagggggaaaccggggggtaaacccgaaggggttccggggttaaacgtttaaccccgtaaaggtttaacccgtttaccggttttacgggaaccggttcccgggttaacgggggtaaccccgg

SEQ ID NO: 352881 - DNA, 696 bp, Homo sapiens
  misc_feature: GZ8MTXP01DQZ7M.10.9.A09.1.454.CMB.2.raw
  modified_base (323)..(323): a, c, t, g, unknown or other
  misc_feature (323)..(323): n is a, c, g, or t
tcagcatagtagtgcacgaccggtgctcgatttagcgagacgcgcagggggggagaggagcccagcactagaagtcggcggtgtttccattcggtgatcagcactgaacacagaggactcatcatggagtctgggctgaactgggttttcctcgttgctcttttaagaggtgtccagtgtcaagtgcaactggtggagtcgtgggggagcgtagtccagccgtgggaggtcacagagactctcctgtgcagcctcgtgggttcaccttcagtagctacggcatgcacgtcgggtcccgaccaaactccgaaggcgaaaggggngttgggaggttggggtggtcttaggtttgttcagttccgtggagggtctagttgttaacaagttggtatgcgtaggaccgcggtaggaacgggtccgtattccaccatcctaccgaagtacgaacaaccgtaccgaaagaactaacgtaaagttacggttaacgtttacgggaaccttacggaaacctacgtacccgttaaagtcccgtaggaacgggtaaccgtacggggttactaacgttaaccgttacggtacgggttaaacgggaaacgggggtaacgggggaaaaccgcggggttaaccgggtaacgttaacccggtaacgtttaacccgttcgtttacgggtaaccgggttccgggttaaccggggg

SEQ ID NO: 352882 - DNA, 779 bp, Homo sapiens
  misc_feature: GZ8MTXP01D0ZQS.10.9.A09.1.454.CMB.2.raw
  modified_base (172)..(172): a, c, t, g, unknown or other
  misc_feature (172)..(172): n is a, c, g, or t
  modified_base (270)..(270): a, c, t, g, unknown or other
  misc_feature (270)..(270): n is a, c, g, or t
  modified_base (318)..(318): a, c, t, g, unknown or other
  misc_feature (318)..(318): n is a, c, g, or t
tcagcatagtagtggcacgaccggtgctcgatttagcgagacgcgcaggggggggagaggagcccagcactagaagtcggcggtgtttccattcggtgatcagcactgaacacagaggactcaccatggagtctgggctgaacttgggttttcctcgttgcttcttttaagnggtgtccagtgtcaagtgcaactggtggagtcgtgggggagcgtagtccagccgtgggagtcacagagactctcctgtgcagcctgtggttccacttnagtagctacgcatgctacgtggtcccaccaaactccgaggcaagggtnttgggagtgggtgctagtttgttcagtcgtggagggctaggttcgttacaaaagttgggtaatgtccgtagggacccggtccggtaggggaacggggtcccgtagtttacccaacctacgtccctaccgaaggaacgaaccctaaacctacccgaaaggaaacctaacgtaaagtttacggttaacggttttaaccgggaacccgtttaacggaaaaccgtaacggtaaccccgttaaaacggttcccggttaagggaaccgggtaaaccgtaccggggtttaagttaacgtaaaccgttaaccggttaggggttaaacccggggaaaggggggtaaaccggggggtaaacccgttacgggggttaaccggggttaacgtttaacccggtaaacggtttaaccccggtttaccggtttaccggttaacccgggttccgggttaaccggggggtaaccccgg

SEQ ID NO: 352883 - DNA, 594 bp, Homo sapiens
  misc_feature: GZ8MTXP01B0GCI.10.9.A09.1.454.CMB.2.raw
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
tcagcatagtagtgcacgaccggtgctcgatttagcgagacgcgcaggggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttnagtagctacggcatgcactgggtccnccaaactccaggcaaggggattgggagtggggtgcagttgtttcatctgagggcagtgtcaaatggtntgctgacgccgtggaagggccgattcacatctccaganacaactcgagaacacaatgtattggacctagaacagacctaagtacctagaacggtaccgacggggtacgtataacgttaacgttaggttaacggaaaggggacggggggtaaaccgacgggacggggacggttaacccggtaacggtaaccgttaccgtttacggttaccgttcggttcgggggtaacccggg

SEQ ID NO: 352884 - DNA, 489 bp, Homo sapiens
  misc_feature: GZ8MTXP01AUZRB.10.9.A09.1.454.CMB.2.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
  modified_base (446)..(446): a, c, t, g, unknown or other
  misc_feature (446)..(446): n is a, c, g, or t
  modified_base (486)..(486): a, c, t, g, unknown or other
  misc_feature (486)..(486): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgctccagggaaangccaccctntcctgcagggccagtcagatgtgcncttganctgacanacaactgcagctccagcccnatcatgncatcaacnggccatggcatccagccaggttcagtcgcagtggtatgggacagcttnactntcaccatcatcagcctgggacncctagaagtatgttagctagtttactactgtacaactagtccgtacgagtcgccgtcggggcctacgttccggcctgggaccaagtgagnttacgaaacgacttgttgactgcaaccatccttgtccttnaac

SEQ ID NO: 352885 - DNA, 530 bp, Homo sapiens
  misc_feature: GZ8MTXP01BCGT5.10.9.A09.1.454.CMB.2.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
  modified_base (424)..(424): a, c, t, g, unknown or other
  misc_feature (424)..(424): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagatgtgcncttgagctgacacacaactgcaggctcccagccctnatctatggtncactcccaacgacgggcccacgtcggcactccccgagccaggttcaggtcggctaggtggtatggggaacagcttcactctcacatcatcagcctggacnctgaagntgtgctagtttatactgtacaactgtcgtaccgngtcggcccgtccgggggcctacgttccggcccgtacgggaacctaaagggtggagtacgttacgaaacgtacgttgcggctaagcaaccgatcttgtccttgtccc

SEQ ID NO: 352886 - DNA, 594 bp, Homo sapiens
  misc_feature: GZ8MTXP01CDTJV.10.9.A09.1.454.CMB.2.raw
  modified_base (273)..(273): a, c, t, g, unknown or other
  misc_feature (273)..(273): n is a, c, g, or t
  modified_base (389)..(389): a, c, t, g, unknown or other
  misc_feature (389)..(389): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggaggtcacagagactctcctgtgcagcctcgtgggttcaccttcagtanctacggcatgcacgtgggtcccgaccaaactccgaggcgaaagggggtattgggaggttgggggtggctagtttgtttcattcgtggaggggctagtgttacaaaagttgggtaangcgtgacggccgtaggaacggccgtattcacatcacgagagacaactaccgaagaacaactaatgttacgtttacggaccttagaaacgagacctaaagtcctagacggacgtacggtagtaataactacgttaggtaacggaagggacgggggaacaggcgggttacgttaacaagtcttaccgtgacgtcgttcgggtaaccg

SEQ ID NO: 352887 - DNA, 750 bp, Homo sapiens
  misc_feature: GZ8MTXP01C9YV7.10.9.A09.1.454.CMB.2.raw
  modified_base (252)..(252): a, c, t, g, unknown or other
  misc_feature (252)..(252): n is a, c, g, or t
  modified_base (322)..(322): a, c, t, g, unknown or other
  misc_feature (322)..(322): n is a, c, g, or t
tcagcatagtagtgcacgaccggtgctcgatttagcgagacgcgcgagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaacgtggtggagtcgtgggggagcgtagtccagccgtgggagtcacgagagactctcctgtncagcctgtcggttcaccttcagtagctacggcatgcacgtgggtcccaccaaactccgaggcgaagggtnttgggagtggggtgctagtttgttcagtcgtggagggtctaggttgttacaaaagttgggtaatggtccgtagggaccggtccggtagggaacggggcccgtattaccgaacctactcctaccgaacggaacgaaccgtaaacctacccgaaacggaaacctaacgtaaagttacggtttaacggtttacggaacccgttaacgaaaccgtaacgtaccccgttaaacggttaccgttaacgggaacggtaaccggtacggggttaacgttaaacgttaaaccgttaacggttaacggggtaaaccgggggaaacgggggtaaaccggggggaaccgttaacggggttacgggttaaccgttaacccggtaaacgttcccgtttaccggttacgggttaccggttccgggttccgggggtaacccggg

SEQ ID NO: 352888 - DNA, 769 bp, Homo sapiens
  misc_feature: GZ8MTXP01C5KLR.10.9.A09.1.454.CMB.2.raw
tcagcatagtagtgcacgaccggtgctcgatttagcgagacgcgcgagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaacgtggtggagtcgtgggggagcgtagtccagccgtgggagtcacagagactctcctgtgcacgtcctcgtggttcaccttcagtagctacggcatgcacgtggtcccgaccaaactccgaggacaagggtatgggaggtgggtgctagtttcgttcagtcgtaggaggggtctaggtcgttacaaaagttggtaatcggtcgtagggaaccgtccggtagggaaacgggcccgtaagttccaacctactcctaccgaaggaacgaacctaaactaccgaaaggaaacactaaagttacgttaagtttacgggaacccttaacgaaaccgtaacgtaacccgttaacggttacccgtaagggtaacggtaaccggtaacggggttacttaaacggttaacccgttaaacggttacggggttaaaaccgggaaacggggggtaaaccggggggtaaacccgttaacggggttaccggggttaaaccggtttaacccgtaaaaaccggttcccggttttaccccggtttacggggttacccgggtttaacccggggttaaccgggggtaaacccccgggg

SEQ ID NO: 352889 - DNA, 662 bp, Homo sapiens
  misc_feature: GZ8MTXP01A8FVA.10.9.A09.1.454.CMB.2.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaancgccacctctcctgcagggccagtcagtaatgttggctcttgaagctagaccaacacaaactggccaggcctcccgacgccctnatctagtggtgactacgtaccaacggacggaccctacgtcggacctactccccgagaccgtaaggttcaaggtcggaccggtagggttcggggtaagtcggggaaactacggttaacctccgtaaccttccaccacctactactactacgaacgtcccgtaggacgtaccgttaaggaacgtattgggttacacgttaagtttactacgtacgtactaaacgtcgttaccggtaccgtagggtcccggtcccggttccggggacccttacggttcccggaccgttaacggggaacctaaaggtcggaaacgtacttaacgaaaacgtcttggttcggccttaagacctaacgttatcttacgtcttaacgtaaccg

SEQ ID NO: 352890 - DNA, 791 bp, Homo sapiens
  misc_feature: GZ8MTXP01BRB8O.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagccgtgggagtcacagagctctcctgtgcagtcctcgtgggttcacttcagtagctacggcatgccacgtcgggtcccaccaaactccgaggacaaggggattgggaggtgggtggcctaggtttgtttcagtctagggagggtctaaggtcgttactaaaaggttggtaacgtgtaccgtgggaacccggtcccgggttagggaaaccggggtcccggtactttacccgaaccgtatcccttaccgaacggtaaacgaaccgttaaacccgtaccgaaacgggtaaacccaaacgttaaaacgttacgggtttaaaggttttaccggtaacccggttaaacgaaaacccgttaaccgtaacccgttaaacggttacccgttaaaggggaacggtaaacccggtacggggttaaccgttaaagttaaaccgttaaccggttaagggttaaacccggggaaagggggtaaaccggggggaaccgttaacggggttccggggttaacgttaacccggtaacgttaaccgtttccgtttaacggccggttaaccgggttcgggggtaacccccggg

SEQ ID NO: 352891 - DNA, 661 bp, Homo sapiens
  misc_feature: GZ8MTXP01EWUYH.10.9.A09.1.454.CMB.2.raw
  modified_base (272)..(272): a, c, t, g, unknown or other
  misc_feature (272)..(272): n is a, c, g, or t
tcagcatagtagtgcacgaccggtgctcgatttagcgagacgcgcaggggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagcctggggagtcacagagactctcctgtgcagtcctcgtgggttcaccttnagtagctacggcatgctacgtcgggtcccaccaaactccgaggcgaagggtattgggaggtggggtgcgtagtttgtttacagttcgtggagggtctagttgttacaaaagttggtaatgcgtggaccgtccggtagggaacgggtcccgtattccacctactcctaccaagaacgaacctaacgtaccgaaggaacaactaagttagttaaggtttacggaaccgtagaacgacgtaccgtaacgtccgtaggacggtacgtacgggtacgtaactaacgtacgttaggtaacgggaaaggggacgggggaaccgagggccggggttaacgttaaccgaacgttaaccgttccggtttaggaccggttcggttaacgggggtaacccg

SEQ ID NO: 352892 - DNA, 696 bp, Homo sapiens
  misc_feature: GZ8MTXP01A0UE5.10.9.A09.1.454.CMB.2.raw
tcagcatagtagtgcacgaccggtgctcgatttagcgagacgcgcaggggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaacgtggtggagtcgtgggggagcgtagtccagccgtgggagtcacagagactctcctgtgcagtcctcgtgggttccaccttcaggtacgctacggcatcgcacgtcgggtacccaccaaactccgaggacgaaggggtattgggaggtggggtgtcgtaggtttcgttcagttcgtagggacgggtctaggttgttacgaaagttgggtaatcggcgtacggaccgggtccggtagggaaacggggtcccgtacttccgacctacgtccgtaccgaaggaaccgaaccaaccgtaccgaaacgaaactaacgtaagttaggttacggtttacggaccttaagaaaccgtacgaccgtaacgtccgtaggaacggtaccgtacgggttagtaacgtaacgttaacggttagggtaaacgggaaagggggaacgggggtaacgacggggcggttacgtaaccgtaaggtccgttcgtacggttaccggtcggttcggggtaacccgg

SEQ ID NO: 352893 - DNA, 649 bp, Homo sapiens
  misc_feature: GZ8MTXP01C0KH1.10.9.A09.1.454.CMB.2.raw
tcagcatagtagtgcacgaccggtgctcgatttagcgagacgcgcaggggggggagaggagcccagcactagaagtcggcggtgtttccattcggtgatcagcactgaacacagaggactcaccatggagtctgggctgaacttgggtttttcctcgttgcttcttttaagaggtgtccagtgtcaagtgcaacgtggtggagtcgtgggggagcgtagtccagccgtgggagtcacagagactctcctgtgcacgcctcgtggttcaccttcagagctacgcatgcacgtggccaccaaactccaggcaagggatgggagtggggtgcgtagtttgttcatcgtaggagggtctaggttgttacaaagttggtaatcgcgtaggtaccggccggtagggaaacgggcccgtacttccacctactccaccgaagacgaaccaacctaccgaagaaacaactaagttagttacgtttacggacctagaacgtacgacctaagtcctaggacgtacgtacggtagttaactaacgtacgttagggtaaacgggaacggggaacgggggtaaccgacgggttccgggttaacgttaacccgtaagttccgtttaccgttacggttaccggttccggttcgggggtaacccgg

SEQ ID NO: 352894 - DNA, 691 bp, Homo sapiens
  misc_feature: GZ8MTXP01BUCGC.10.9.A09.1.454.CMB.2.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (274)..(274): a, c, t, g, unknown or other
  misc_feature (274)..(274): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcagggccagtcagatgtgcncttganctgacacacaactgcagctccacgccctnatctagtggtgacactccaaacgacggggacccacgtcggaccactccccgagcccgtaggttccaggtcggacgtaggtggggtactggggaaacagtcttcactctacacctatcactcacgccgtagggacgtaccgtaggaaacgtgttacggttcgtacgttaagttttaacttaccgttggttaaccctaaacgttacggtttacccggtaaccgggtacggtccgggtccccgggttacccggggggtacccttaccgggtttccccggggacccggttacgggggaaacccgtaaaaggggtcgggttaaacgtaacgttaaaccgaaaacgggtacgtttacggggcggttaccgtaacggaccctaacgtaacgttccgttacggttcccgtttaacgttaaccccg

SEQ ID NO: 352895 - DNA, 717 bp, Homo sapiens
  misc_feature: GZ8MTXP01CNIZ0.10.9.A09.1.454.CMB.2.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgctccgagggaaangcccaccctctcctgcagggccagtcagtatgtgcgtccttgaagctgtaccaacacaactgcaggctccagccctnatctatggtnccatcccgaaacgacgggcccaacgtcggacctaacgtcccccgaaggcccctaaggggtttccaaggttcgggaccagggtggggtaatcgggggaaactagcctttcgaccttctaccaccattcatcacgcccgtagggacgtccgtaggaaagtagttgttacgtacgttagtttaattaccgttacggttaaccaaacgttaacggttccggtaaacccgggtacgggttcccggggtccccggttaccccggggggtaccccttaccggttttccccggggaccccgtttacgggggaaaccctaaaacggggttcgggaaaccggtaacgttaccgtaaaaaccgggtacgttcgggttcgggttacccgttaaggaccccgtaactaaccgttccgttagttaacccgtttaacgtccccg

SEQ ID NO: 352896 - DNA, 552 bp, Homo sapiens
  misc_feature: GZ8MTXP01DVW9E.10.9.A09.1.454.CMB.2.raw
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (381)..(381): a, c, t, g, unknown or other
  misc_feature (381)..(381): n is a, c, g, or t
  modified_base (532)..(532): a, c, t, g, unknown or other
  misc_feature (532)..(532): n is a, c, g, or t
  modified_base (546)..(546): a, c, t, g, unknown or other
  misc_feature (546)..(546): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaagagccaccctctcctgcagggccagtcagaatgtggcgtcttgtaagctggtaccaacacaaacctggccaggctcccaggcccctnatctatggtgcatccaacngggcccacgtggcatcccagcccaggttcaggtcggcaggtgggtatggggaacagtcttcactctacaccntcatcagcctggagcctagaagtattgttgctagtttattactgtactaactagtcgtacgaggtcggccgtccggggcctcgttccggaccgtcgggaccaaaggtggacgattaccgaaacgtacgttggttcggctcggctaaccgtntccgttgttccttntaaccc

SEQ ID NO: 352897 - DNA, 775 bp, Homo sapiens
  misc_feature: GZ8MTXP01AZU19.10.9.A09.1.454.CMB.2.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccacctgtctttgtctccgaggggaanacgccaccctctccgtgcgaggccagtcagtatgtggcgtcttcgtaagctagtaccaacacaaacctggccaggcctcccacggccccctnactcctagtggtgccactacccgaaaccgaggggaccccaacgtcggaccaacgttcccccgacggccgtaacggggtttaccaggggttaccgggacgtacgggggttggggtaacgtcggggggaaaacctaacgggttaacctttaccggacctttaccctaccctaaccctaacttacctaaacttcccgtaaacgtccccggttaggggaaccgtacccgtagggtaaaacggttgtttacgggttctacgttaagtttactacgttacggtactaactcgttaccgtaaccgggacggttccgggcccggttacccgggggtacccttacgggttttccccgggacccgttacggggaacccggtaaaggttcggggacggtaaacgttaccgtaaaacgggttaacgttcggggtttcggaccgttgaacccgttaaccgtacgtttcgttaccgtttccttaacccgtttcccg

SEQ ID NO: 352898 - DNA, 536 bp, Homo sapiens
  misc_feature: GZ8MTXP01CDEYF.10.9.A09.1.454.CMB.2.raw
  modified_base (204)..(204): a, c, t, g, unknown or other
  misc_feature (204)..(204): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (356)..(356): a, c, t, g, unknown or other
  misc_feature (356)..(356): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (503)..(503): a, c, t, g, unknown or other
  misc_feature (503)..(503): n is a, c, g, or t
  modified_base (520)..(520): a, c, t, g, unknown or other
  misc_feature (520)..(520): n is a, c, g, or t
  modified_base (530)..(530): a, c, t, g, unknown or other
  misc_feature (530)..(530): n is a, c, g, or t
tcagcatagtagtgcacgaccggtgctcgatttagcgagacgcgcaggggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagaatgtggcgccttgagctgtacaacacaactggcaggctcccagcccctnatctatggtncatccaacgaggggccacgtcggcactcccagccaggttcagtcgcaggtgggtatgggaaacngtctcactctacacctatcactcagccctggacnctagaagtnttgtgtactagtttactatgtacaatagtccgtaacgtggtcggcccggtccgggggtcctacgtttccgggacctggggaaccaaggtcgagtacagaaacgnttcggttgctgctaacntcttgtcttntaaccg

SEQ ID NO: 352899 - DNA, 638 bp, Homo sapiens
  misc_feature: GZ8MTXP01B927S.10.9.A09.1.454.CMB.2.raw
  modified_base (316)..(316): a, c, t, g, unknown or other
  misc_feature (316)..(316): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagccgtgggagtcacagagactctcctgtgcagcctcgtggttcacttcagtagctacggcatgcacgtcggtccaccaaactccgaggcaagggtnttgggagtgggtgctagttgttcattcgtggaggtctagttgttacaaagttggtaatgcgtacggacggccggtagggaaacgggtccgtacttcgacctctcctaccgagaacgaaccaacctaccgaagaaccactaagttacgttacgttacggaccttacgaactacgtaccgttaacgtccgtaggacggtacgtacgggttactacgtaacgtacgttacggtaaacgggaaggggtaacgggggaacacggggttcgggttacgttaaccgtaacgttccgttcgttacggaccggtcggttcgggtaacccgg

SEQ ID NO: 352900 - DNA, 729 bp, Homo sapiens
  misc_feature: GZ8MTXP01AKV4H.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggagcgtagtccagcctgggagtcacagagactctcctgtgcagcctcgtgggttcaccttcagtagctacggcatgcacgtcgggtccaccaaactccgaggcaaggggattgggagtgggtggctaggtttgttcagtcgtggacggggctaggttcgttacaaagttgggtaatcggcgttggaccggtccggttaggaaacggggtcccgtacttccaccctaatcctaccgaaggaacgaacctaaaccgtacccgaaagggaaaccaacgtaaagttcggttaaacgttttacgggaaacccgttacgggaaaaccctacggtacccgttaaacggttccccgttaagggaacgggtaaccgtacgggggttacgttaacttaacggtaacgttacgggtaaaccgggaaacgggggtaacgggggtaaacccgaggggttaccggggttaacgttaacccgtaaacgttcccgttccgtttagggttacccggttcgggttcgggggtaaccccgg

SEQ ID NO: 352901 - DNA, 614 bp, Homo sapiens
  misc_feature: GZ8MTXP01A5X0G.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctggggagtcacagagactctcctgtgcagtcctcgtgggttccaccttcagtagctacggcagtgcacgtcgggtcccaccaaactccgaggacgaaggggtattgggaggtggggtggctaggtttggtttcagttcgtggaggggtctaggttgttacaaaattgggtaatgcttcggaacggccggttagggaaacgggtcccgtattccgactacgtcacgagacgactaaccgtaccaggaacacaattgtagtttacgaactgaacacgtcctaagtccgtagacggtacgtagggtctaagtaactacgttaggaacggaagggaacgggggtaacagggcggttagtaaccgagtaacgtcgttcggacgtcggcgggtaacccg

SEQ ID NO: 352902 - DNA, 701 bp, Homo sapiens
  misc_feature: GZ8MTXP01BNXK2.10.9.A09.1.454.CMB.2.raw
  modified_base (269)..(269): a, c, t, g, unknown or other
  misc_feature (269)..(269): n is a, c, g, or t
  modified_base (330)..(330): a, c, t, g, unknown or other
  misc_feature (330)..(330): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggctttcctcgttgcttcttttaagaggtgtccagtgtcaagtgcaacgtggtggagtcgtgggggagcgtagtccagccgtgggagtcacagagactctcctgtgcagcctcgtggttcaccttnagtagctacggcagtcgccacgtcgggtaccccaccaaaccgtccgaggacgaaaggggtnttaggggaggttggggtggacttaggtttcgtttacagttccgtggagggtctaggttgttaacaagtggtatgctggaccgtcggtaggaacgggccgtattaccgaccataccgtaccgaacgacgaaccaaccgtaccgaacggtaaacaacgtaagttcggggttaactttacgggaacccttacgaaaccgtaccgtacccgttaaagtacccgtaggaacgggtaaccgtacggggtagtaaacgttaacgttaacggttacggttaaacgggaaaggggaacgggggttaacccgacggggttaccgggtaacggttaccgaacgttccgttacgtttacggtaaccggttcggtaaccggggg

SEQ ID NO: 352903 - DNA, 727 bp, Homo sapiens
  misc_feature: GZ8MTXP01A4Y5J.10.9.A09.1.454.CMB.2.raw
  modified_base (327)..(327): a, c, t, g, unknown or other
  misc_feature (327)..(327): n is a, c, g, or t
  modified_base (394)..(394): a, c, t, g, unknown or other
  misc_feature (394)..(394): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagccgtgggagtcacagagactctcctgtcgcacgtccctcgtggttccaccttcagtagctacggcatgcacgtcggtcccaccaaacgtccgaggacgaaggggtnttgggaggtgggtgtcgtaggtttcgttcagttcgtggagggtctaggttgttacaaaggttgggtntcggtcgttacgggaccggtccggtaggggaacgggtaccgtacttccgaacctacgtcccgtaaccgaacggaaccgaacctaaacccgtaaccgaaacggaaacctaacgtaagttacggttaacggtttaccggaaccgttaacgaaaccgtacgtaacccttaaggtccctaagggacggtaaccggtacgggttacgtaacgtaacgtacggttacgggtaaacggggaacgggggaacgggggtaaccgacggggttccgggttacgttaacccgtaacgtttaaccgttccggttacggaccggttccgggttcggggtaacccgg

SEQ ID NO: 352904 - DNA, 739 bp, Homo sapiens
  misc_feature: GZ8MTXP01BDACV.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtgagtcgtgggggagcgtagtccagccgtgggagtcacagagactctcctgtgcagtcctcgtgggttcaccttcagtagctacggcatgcacgtcgggtccaccaaactccaggacaagggattgggagtggggtggctaggtttcgttcagtccgtggaggggtctaaggtgttacgaaagttggtaagtgacgtcggaccggtaccggtacgggaaacggggcccgtaagttcccgacccgtacgttacccgtacccgaaagggtaaccgtaaaccgaaaccttaccccggaaaggtaaacccaaacgtaaagttacggttaacgttttacggggtaaccccttaagtaaaccgaaccgtacccgttaaacgttaccgttacgggaaacggtaccggtacgggggttacttaaggttaacgttaaccgttagggtaaaccgggaagggggaaacgggggtaaacccgagggcggggttaacgttaaccgaaaggtttaaccttccgggtttacggaccggttaacggttcgggggtaacccgg

SEQ ID NO: 352905 - DNA, 545 bp, Homo sapiens
  misc_feature: GZ8MTXP01ALM5Z.10.9.A09.1.454.CMB.2.raw
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (410)..(410): a, c, t, g, unknown or other
  misc_feature (410)..(410): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggagtcacagagactctctgtgcagcctctgggttcaccttcagtagctacggcatgcacgtgggccaccaaactccaaggcaaagggattggagtgggtgctagtttgttcatctgagggcagtgtcaaaatggaatgntgacncgtgaaagggccgatcacatctcagagacaactcgagaacanaatgtattaggacctagaacagacctaaagtcctagaggaccagggtgtaataactattggtaacgaaagggagggggaaccagggcgggaacttaaccgaagttaaccgtccttggacgtcgttggggaacccg

SEQ ID NO: 352906 - DNA, 509 bp, Homo sapiens
  misc_feature: GZ8MTXP02F6KZA.10.9.A09.1.454.CMB.2.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcaggccagtcagatgtgcncttgagctgacancaacngcagctcccagcccctnatctatggtncatccaanaggccatggcatcccagccaggttcagtggcaggtgggtatgggaacagcttcactctcaccatcatcagcctgagcctgaagatgtgctagtttattactgtacaactatacgtacgagtcggccgtccgggggcctacgttcggcccgtacgggacccgaaaggtcggaagacgtacgaaacgaacgtagtagacgtgcacctactctcgtcttctac

SEQ ID NO: 352907 - DNA, 528 bp, Homo sapiens
  misc_feature: GZ8MTXP02G7N2Y.10.9.A09.1.454.CMB.2.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (361)..(361): a, c, t, g, unknown or other
  misc_feature (361)..(361): n is a, c, g, or t
  modified_base (454)..(454): a, c, t, g, unknown or other
  misc_feature (454)..(454): n is a, c, g, or t
tcagcatagtagtgcacgaccggtgctcgatttagcgagacgcgcagggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcacgtgggtcccnccaaactcccaggcaagggnttgggagtgggtgctagttgttcatctgagggcagtgttcaattggtntgctgacgccgtgaagggccgatcacatctcagagacaactcagacacaatgtattggactagaacagacctaagtcctgacggacacgggtntatactactaggtacgaagggacgggggaaccaggcgggagtccgaagtactccgttagacgtcgtgggtaccg

SEQ ID NO: 352908 - DNA, 575 bp, Homo sapiens
  misc_feature: GZ8MTXP02HEQ6V.10.9.A09.1.454.CMB.2.raw
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcactgggtccnccaaactccaggcaaggggnttgggagtgggtggcagttgttcatctggagggcaggtnttcaatgggtatgctggacgccgtgaaacggggccattcaccatctccagagacaactcagacacaatgtattcggactgaacagacctaagtcctagaacggacgacggggtatactaacgtacgtaggtaacggaaggggaacgggggaacccagggccggggtaagttaaccgaaaggttaccgttaccgtttacggaccggttcggttacgggggtacccg

SEQ ID NO: 352909 - DNA, 497 bp, Homo sapiens
  misc_feature: GZ8MTXP02GCH8I.10.9.A09.1.454.CMB.2.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaanagccaccctctcctgcagggccagtcagatgtgcncttgagctgacanacaacngcagctccagccctnatctatggtncatccaacagggccatggcatcccagccaggttcagtcggcaggtgggtatggggacagcttcactctcaccatcatcagcctggagcctagaagatgttgctagtttattactgtacaactatacgtacgagtcggccgtccgggggcctacgttcggcccgtgggaccaaggtggagactacaaacgaactcgtgctgcacactctgtcttctac

SEQ ID NO: 352910 - DNA, 808 bp, Homo sapiens
  misc_feature: GZ8MTXP02G7DSU.10.9.A09.1.454.CMB.2.raw
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggaggtcacagagactctcctgtgcagcctgtggtcaccttcagtagctacggcatgcacgtggggtcccaccaaaacgtcccgaggacaaaggggtatttggggaggtggggtggctaggtttgtttcagttcgtggaggggtctaggttgttacaaagttgggtatcggcttcgggaccgtcccgggttagggaaacggggtccccgtaagtttccgaacccgtaacttccgtacccgaaggaacgaacccaaaccgttacccgaaacgggaaaccaacgtaaagttacggtttaaacgttttacggggtaacccttacggaaaaccgtaacggtaaccccgttaaacggttaccccgttagggaaacggggtaaccgtaaccgggggttagttaaaaccgttaaaccgttaaaccggttaagggttaaacccggggtaaaaggggggaaaccggggggtaaaacccgaacgggggtaacccgggggttaaacggtttaaccccggtaaaacgggtttaacccgtttacccgggttttaacgggaacccggtttccggggttaaccggggggttaacccccggg

SEQ ID NO: 352911 - DNA, 521 bp, Homo sapiens
  misc_feature: GZ8MTXP02GOWF5.10.9.A09.1.454.CMB.2.raw
  modified_base (202)..(202): a, c, t, g, unknown or other
  misc_feature (202)..(202): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgcttcgaagctggtaccaacacaaacctggccaggctcccaggcccctcatctatggtgcatccaacagggccactggcatccccagccaggttcagtcggcaggtgggatgggacagcttcactctcaccatcatcagcctggagcctgaagatgttgctagtttattactgtacaactatcgtaccgagtcggccgtccgggggcctacgtttccggcccgtgggaccaaaggtcggagactacgaaacgactcgtgctgcacgactcgtcgtcttctac

SEQ ID NO: 352912 - DNA, 558 bp, Homo sapiens
  misc_feature: GZ8MTXP02IDQ2C.10.9.A09.1.454.CMB.2.raw
  modified_base (292)..(292): a, c, t, g, unknown or other
  misc_feature (292)..(292): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccnccaaactccaggcaagggattgggagtggggtggctaggttgtttcatctggaggggcagtgttcaagtggtatgctggacgccgtggaacgggccgattcaccatctccagagacaactccaagaacacaatgtattggacctagaacagcctaagtcctagacggacgacgggtagtatacgtacgtaggtacggaaagggacgggggaaccgacggacgggtagtaaccgaacgttactcgttagacgtcgtacggggtaccg

SEQ ID NO: 352913 - DNA, 560 bp, Homo sapiens
  misc_feature: GZ8MTXP02F4UFA.10.9.A09.1.454.CMB.2.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
tcagcatagtagtgcacgaccggtgctcgatttagcgagacgcgcagggggaggaactctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagaatgttggcncttgaagctggtaccaacacaacctggccaggcctcccaggcccctnatctatggtncatcccaacgagggcccacgtggcactcccagcccaggttcaggtggccaggtgggtangggacagacttcactctacaccatcatcagcctggacgcctagaagtagtgttagtcgtagtttattacttagtacaactactacgtaccgtaggtcggcccgtccgggggtcctaccgtttcggcccgtacgggacgaaaggtacggacgagtacgaaacgacgtacgtacggctgaacacgtactctcgtcttctacttcccg

SEQ ID NO: 352914 - DNA, 849 bp, Homo sapiens
  misc_feature: GZ8MTXP02G523S.10.9.A09.1.454.CMB.2.raw
  modified_base (391)..(391): a, c, t, g, unknown or other
  misc_feature (391)..(391): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtggggaggcgtagtccagcctgggaggtcacagagactctcctgtgcagcctcgtggttcaccttcagtacgctacggcagtcgcacgtcgggtccccaccaaaactccgaggaccgaagggtattgggagtggggtggcgtaggtttgtttcagttcgtagggagggtctaggttgttacaagttgggtntcgcgttggaccggtccggtagggaaacggggtcccgtaacttaccgaaccctacgtacccgtaccgaaacggaacgaaaccctaaacccgtaacccggaaacgggaaaaccctaaacgtaaaagtttacggtttaaacgtttaccggggtaaacccttaacgggtaaaaccgtaaaccggtaaccccgtttaaaccgggttaccccggttaacggggaaaccggggtaaacccgggttaaaccgggggtttaacgtttaaaccggttaaaacccggtttaaccggttaaacggggttaaaaccgggggtaaaacgggggtaaaccgggggggtaaaaccccgaacgggggtaacccgggggttaaccggttaaaccccggtaaaacgggtttacccgtttacccggttttaccggggtaacccggtttacccggggttaccgggggtaacccccggg

SEQ ID NO: 352915 - DNA, 607 bp, Homo sapiens
  misc_feature: GZ8MTXP02I4E67.10.9.A09.1.454.CMB.2.raw
  modified_base (317)..(317): a, c, t, g, unknown or other
  misc_feature (317)..(317): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggaggtcacagagactctcctgtgcagcctcgtgggttcaccttcagtagctacggcatgcacgtcgggtcccaccaaactccgaggcaaggggnttgggagtggggtggctagttgtttcattcgtggagggctagtgttacaagttgggtatgctgaccgccgtaggaaacgggccattcaccatctccagagaccaactccaagaacacaatgttattcggactagaacacgacctaagtccgtagaacggacgtacggggtagtaacgtaactacgtaggtaaacgggaaaggggaacggggggaaccaggggtacgggtaacgttaaccgtaaacgttaccgttaccggtttaggtaccggttcggtacggggtacccgg

SEQ ID NO: 352916 - DNA, 512 bp, Homo sapiens
  misc_feature: GZ8MTXP02ISYS0.10.9.A09.1.454.CMB.2.raw
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccacctgtctttgtctccaggggaaanagccacctctcctgcagggccagtcagaatgtggcncttcgaagctggacacacaaacctgcaggctccagcccctnatctanggtncatccaacnggccanggcatcccagccaggtcagtggcagtggtangggacagcttcactcncacatcatcagctgancctgantgtgactagttattactgtacaactatacgtacgagtcggcccgtacgggggcctacggttccggccgtacgggaacctaaaggtgagtactaaacgaaacgacgtgaggctggccaacgtactctcgttacttctaccg

SEQ ID NO: 352917 - DNA, 518 bp, Homo sapiens
  misc_feature: GZ8MTXP02FPYBA.10.9.A09.1.454.CMB.2.raw
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggaggcgtagtccagcctgggagtcacagagactctcctgtgcagcctctgggttcaccttcagtagctacggcatgcactgggtccgccaaactccaggcaaggggattggagtgggtgcagttgttcatcngagggcagtgttcaatggtntgctgacgcgtgagggcatcacatctccagagacaactccagaacacaatgtattggactgaacagacctaagtcctgaggacgacgggtgtatactactgtacggaaagggacgggggaaccaggcggagtcgaagtactcttgacgtcgtacgggtccg

SEQ ID NO: 352918 - DNA, 723 bp, Homo sapiens
  misc_feature: GZ8MTXP02GVFTD.10.9.A09.1.454.CMB.2.raw
  modified_base (317)..(317): a, c, t, g, unknown or other
  misc_feature (317)..(317): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggagcgtagtccagcctgggagtcacagagactctcctgtgcagcctgtggttccaccttcagtagctacggcatgcacgtcgggtcccaccaaactccaggcaaaggggnttgggagtggggtgctagtttgttcagtcgtggagggtctagttgttacaagttgggtatgcgtggaccgtccggtaggaaacggggtcccgtaacgttccaacccgtatccgtaccgaaggaacgaaccctaaaccgtacccgaaacgggaaaaccaaccgtaaaagttacggttaagttttacggggaaacccttaggaaaacctacggtaacccttaaacggtacccgtaaggaacggggaaccgtaaccgggggttagttaaacgttaaccgtaaccgttacgggtaaacgggaaaacgggggaaaccgggggaaaccgacggggtacgggtaaccggttaaccgaaacggttaccccgtttacgtttacggtaccggtttccggtacgggggtaaccccgg

SEQ ID NO: 352919 - DNA, 532 bp, Homo sapiens
  misc_feature: GZ8MTXP02JBQ0O.10.9.A09.1.454.CMB.2.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccacctgtcttgtctccaggggaanagccaccctctcctgcagggccagtcagatgtgcncttgantgacacacaacngcagctccagccctnatctatggtncatccaacacgggccacgtgcactcccagccaggtcagtcgcaggtggtatggacagcttcactctcacatcatcagtcctgacgctagaacntagtncgtatttagtactgtacaactagtcgtacgagtcggccggtccggggcctacgtttccggaccgtacgggaacctaaagggtcggagaacgtaacgaaaacgtacgtacggtcggtaccgtaaggaccctaacctagtcctacgtttcctactaccg

SEQ ID NO: 352920 - DNA, 708 bp, Homo sapiens
  misc_feature: GZ8MTXP02JOQ0G.10.9.A09.1.454.CMB.2.raw
  modified_base (318)..(318): a, c, t, g, unknown or other
  misc_feature (318)..(318): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggaggcgtagtccagcctgggagtcacagagactctcctgtgcagcctcgtgggttccaccttcagtagctacggcatgcacgtcgggtcccaccaaactccgaggcaaggggnttgggaggtggggtgctagtttgtttcagttcgtggagggctaggtgttacaagttgggtatgctaggaccgtccgtaggaaacggggtcccgtagttccacctactcctacccgaagtaacgaaccaaccgtacccgaaacgggtaaaccaacgtaaagttcggttaacgtttacggaacccgttaagggaaacctaacgtacccgttaaacggttcccgtaggaacggtaacgtaaccggggtagttaacgttaacgtacgttacgggaaaccgggaaagggggtaaacgggggaaacccgtaaggggtaccggggtaaacggttaacccgtaaacggttaacccgttaccggtttacggtaaccggttcggtacgggggtaccccgg

SEQ ID NO: 352921 - DNA, 546 bp, Homo sapiens
  misc_feature: GZ8MTXP02JJV8M.10.9.A09.1.454.CMB.2.raw
  modified_base (202)..(202): a, c, t, g, unknown or other
  misc_feature (202)..(202): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (422)..(422): a, c, t, g, unknown or other
  misc_feature (422)..(422): n is a, c, g, or t
tcagcatagtagtgcacgaccggtgctcgatttagcgagacgcgcagggggaggaactctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagatgtgcgcttgaagctggaccaacacaacctgccagcctccagcccctnatctatggtncatccaacgnggcccagtggcatcccagccaggttcaggtggccaggtgggtatggggacagacttcacttcacaccatcatcagtcctggacgctagaagtatcgttgacttagtttattacgtagtactaanacgtcgtacgaggtcggccgtccgggggacctacgttccggcccgtaggaaccgtaaggtcggagactacgaaaacgtacgtcgtacggctcgaaccgacactcgtcgttactactacttcccg

SEQ ID NO: 352922 - DNA, 530 bp, Homo sapiens
  misc_feature: GZ8MTXP02FII79.10.9.A09.1.454.CMB.2.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagcatagtagtgcacgaccggtgctcgatttagcgagacgcgcagggggaggaactctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgcctccgtaagctggtaccaacacaaacctggccaggctcccaggccccctnatctatggtncatccaacagggcccatggcatcccagccaggttcagtggcagtggtatgggacagacttcactctcaccatcatcagctggagctgaagatgttgctagtttattacttagtcaaactatcgtaccgaggtacggcccgtcccgggggcctacgtttccggcccgtacgggaccgaaaaggtcggagatacgaaaacgactgtacggctgcaccatctgtctcacttcc

SEQ ID NO: 352923 - DNA, 564 bp, Homo sapiens
  misc_feature: GZ8MTXP02FVGEP.10.9.A09.1.454.CMB.2.raw
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (397)..(397): a, c, t, g, unknown or other
  misc_feature (397)..(397): n is a, c, g, or t
  modified_base (422)..(422): a, c, t, g, unknown or other
  misc_feature (422)..(422): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggagcgtagtccagcctgggagtcacagagactctcctgtgcagcctctgggttcaccttcagtagctacggcatgcacgtgggtccnccaaactccaggcaagggnttgggagtggggtgctagtttgttcatcgtggagggcagtgttcaatggtatgctagacgccgtagaacgggcattcaccatcnccagacacaactcaagacacaagtntagttcggactagaaacacgtacctaagtcctaggaacggacacgggtacgtatactagtacgtaacggaaacggggacgggggaaccagggcgggtaacgtaaccgaagtaccgtcgttagacggtacgtcggggtaccgg

SEQ ID NO: 352924 - DNA, 592 bp, Homo sapiens
  misc_feature: GZ8MTXP02HAJ8X.10.9.A09.1.454.CMB.2.raw
  modified_base (254)..(254): a, c, t, g, unknown or other
  misc_feature (254)..(254): n is a, c, g, or t
  modified_base (317)..(317): a, c, t, g, unknown or other
  misc_feature (317)..(317): n is a, c, g, or t
  modified_base (489)..(489): a, c, t, g, unknown or other
  misc_feature (489)..(489): n is a, c, g, or t
tcagcatagtagtgcacgaccggtgctcgatttagcgagacgcgcagggggggagaggagcccagcactagaagtcggcggtgtttccattcggtgatcaacactgaacacagaggactcaccatggagtctgggctgaactgggttttcctcgttgctcttttaagaggtgtccagtgtcaagtgcaactggtggagtcgtgggggagcgtagtccagcctgggaggtcacagagactctcctgtgcagcctntggttcaccttcagtagctacggcatgcacgtcgggtcccaccaaactccgaggcgaaagggnttgggagtggggtgctagttgttcatcgtgagggtcagtgtacagtggtatgctgacgtccgtaggaacgggccattcacctatcctcgaagacgaacaacctccaacggaaaccaactaatagttatttacggacctagaacacgtactaagtcctagacgacgtacggtntaactactacgtaggtaacggaacggggtacgggggaaaccagggaccgggtacgttaccgaacgttacgttacgtagtaccggtcggtcgggaccgtacggg

SEQ ID NO: 352925 - DNA, 643 bp, Homo sapiens
  misc_feature: GZ8MTXP02H78UX.10.9.A09.1.454.CMB.2.raw
  modified_base (202)..(202): a, c, t, g, unknown or other
  misc_feature (202)..(202): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctccagtttcagataccaccggagagattgtgttgacacagtctccagccaccctgtctttgtctccagggggaaanacgccaccctctcctgcagggccagtcagaatgtgcgcttgaagctggtaccaacacaaactggccaggctcccagccccctnatctagtgncactaccaacgacggccacgtgcactccagcctaggtcagtcggcgtaggtggtagtgggacacgtactcactctaccacatacatcacgcgtaggacgaccgtagaagtagttggttacgtacgttagtttaacttacgttacgtaacctaacgtacgttaccggtaaccggtacggtccgggtcccggtacccgggggtacccgttaccgggtttacccgggtaccccggtacggggtaaacccgtaaaacgggtacggtaacgtaacgtaaaccggaaaacggtacgtacggtacggaccgtaacgaccgtaaccgtacgtaccgttacgttacctttaccgtacg

SEQ ID NO: 352926 - DNA, 546 bp, Homo sapiens
  misc_feature: GZ8MTXP02JLRAC.10.9.A09.1.454.CMB.2.raw
  modified_base (356)..(356): a, c, t, g, unknown or other
  misc_feature (356)..(356): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccaccaaactccaggcaagggattggagtgggtggcagttgttcatctgagggcagtgtcaatggtntgctgacgcgtgaagggcatcacatctcagagacaactccaagaacacaaatgtattcggactgaacagacctaagtcctagaggacgacgggtgtaatactacgtagtaacggaaagggacgggggaaccgaggccgggaagttaaccgaacggttacgtccgtttaggacggtcgtacggggacccgg

SEQ ID NO: 352927 - DNA, 714 bp, Homo sapiens
  misc_feature: GZ8MTXP02GWCN3.10.9.A09.1.454.CMB.2.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgtgcnctganctgacanacaacngcagctccagccctnatctatggtncatccaacgacggggcccacgtggaccctactccccgaagccctaagggttccaggtccgggctagggttggggtatcggggacagggtccttcactctacaccattcatcgagtcccgtggacgtcctaggaaagtagttggttacgtaccttaggtttttaacttaacgttacgtaacctaaaacgttacgttacccgggttaacccgggtaagggttacccggggtcccccgggttaccccgggggggtaccctttaacccgggttttcccccggggaccccggttaacgggggtaaaacccccgtaaaaggggttcggggaaacgtaaccggttaaacccgaaaaaccgggtaaccgttcgggttaacggccgttaacgggaacccctaaccgtaacggttcctttcggtttacctttacccgttaacccg

SEQ ID NO: 352928 - DNA, 632 bp, Homo sapiens
  misc_feature: GZ8MTXP02I5SP4.10.9.A09.1.454.CMB.2.raw
  modified_base (170)..(170): a, c, t, g, unknown or other
  misc_feature (170)..(170): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagnggtgtccagtgtcaagtgcaactggtggagtcgtgggggaggcgtagtccagcctggggagtcacagagactctcctgtgcagcctctgggttcaccttcagtagctacggcatgcacgtcgggtcccaccaaactccgaggacgaaggggattgggaggttggggtggctaggtttgtttcagttcgtggagggctaggttgtttacaaagttgggtatgctgaccgtccgtaggaaacgggccgtatcacctatcctaccagacgaaccaactaccgaaagaacaactaaagttagttagttacggacctagaaactagaccctaaagtcctaggacggacgtacgggtataactacgtacgtaggtaaacgggaaaggggacgggggaaccgacgggtacgggtaacgttaacccgtaagtaccgttacgttacggacggttccggtacggggtacccg

SEQ ID NO: 352929 - DNA, 717 bp, Homo sapiens
  misc_feature: GZ8MTXP02GJUV9.10.9.A09.1.454.CMB.2.raw
  modified_base (316)..(316): a, c, t, g, unknown or other
  misc_feature (316)..(316): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagcctgggagtcacagagactctcctgtgcagcctcgtggttcaccttcagtagctacggcatgcacgtgggtcccaccaaactccgaggcaagggnttgggagtggggtgctagtttgtttcagttcgtggaggggctagttgttacaaagttgggtatcggcttaggaccgtccggtaggaaacggggtcccgtaattcccaacctatcccgtaccgaagaacgaaccaaaccgtcccgaaaggaaaaccaacgtaaacgtttaggttaacgttttacggggaacccttaaggaaaccgtaacgtacccccgttaaaaggtcccgtaaggaaaccggggtaacgtaccgggggttataaccgttaaacgtaaccggttagggtaaaccgggaaaagggggaacgggggtaaacccgaggggtaaccggggtaacgtaacccgtaaaaggttaccgtttaccggtttaggtaccggtccgggtacggggtaacccgg

SEQ ID NO: 352930 - DNA, 633 bp, Homo sapiens
  misc_feature: GZ8MTXP02IDMLH.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggagcgtagtccagcctgggagtcacagagactctcctgtgcagcctcgtggttcaccttcagtagctacggcatgcacgtcgggtccaccaaactccgaggcaaaggggtattgggagtggggtggctaggtttgtttcatctggagggctagtgttacaagttggtactgctggaccgtccggtaggaaacgggtcccgacttacacctatcctaccgagacgaacaacaccgaaggaacaacaaatagttaacgtttacgggacctagaaacacgtaccctaaagtcctaggaaggtaccgacgggtagtaacgtaactacgttaggtaaacggaaagggggaaacgggggaacgacgggacgggtaacgttaacccgtaaagttacgttaccgtttaggtaccgttacggtcggggtacccgg

SEQ ID NO: 352931 - DNA, 673 bp, Homo sapiens
  misc_feature: GZ8MTXP02HI0EQ.10.9.A09.1.454.CMB.2.raw
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggagcgtagtccagcctgggaggtcacagagactctcctgtgcagcctctgggttcaccttcagtagctacggcatgcacgtcgggtccccgaccaaactcccgaggcaaaggggtattgggagttggggtggctaggtttgtttcagttcgtggaggggctagttgttacaaagttgggtatgctggaccgtccggtaggaacggggttcgattccacctatcctacgagacgaccaaacctaccgaaaggaaacacaaagttgttaagtttacggaaccttagaaacctaacgtacccgtaaacgtcccgtaggtaacgggaaccgtacggggttacgtaacgttaacgttaacgtaggtaaaccgggaaagggggaacgggggaaccgacggggtaccggggtacgttaacccgaaacgttaccgttaccggtttacggtaccggttccggttacgggggcccgg

SEQ ID NO: 352932 - DNA, 706 bp, Homo sapiens
  misc_feature: GZ8MTXP02JM32Y.10.9.A09.1.454.CMB.2.raw
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctggggaggtcacagagactctcctgtgcagcctctgggttccaccttcagtagctacggcatgcacgtcgggtccaccaaactccgaggcgaaggggattgggagtggggtggctaggtttgtttcattcgtggagggctaggttcgttacaagttgggtatgctggaccgccgttaggaaacgggcccgtagttccaaccctactccgtaccagaacgaccaaaccgtacccgaaacggaaaccaactaaagttacggtttaagtttacgggtaacccttacggaaaccgtacgtacccgttaaacgtcccgttaggaacgggtaaccggtacggggtagttaacgttaaccgttaacggtacggtaaaccggggaaagggggaaccggggggaaaccgtacggggtaccggggtacggttaacccgtaaacggttacccgtttaccggtttacggtacccggttccggtacgggggtaccccgg

SEQ ID NO: 352933 - DNA, 578 bp, Homo sapiens
  misc_feature: GZ8MTXP02GNYUH.10.9.A09.1.454.CMB.2.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcaggccagtcagatgtgcnctganctgacanacaacngcagcnccagccctnatctatggtncatccaaacgnggccacgtggccatccccagcctaggttcagtcggacaggtgggtatggggacagtcttcactctcaccatcatcacgcctggacgcctagaagattgttgacttagtttattactgtacaacgtactaccgtaccggtgtaccgggcccgttcccgggggccttacggttcccgggcccggtacggggaacccgtaaaagggtcggaacggtaacgtacgtaaaaccgtacgtagggttcggacgttaacggaccctacctacgttccttacggttcctttacgtaccg

SEQ ID NO: 352934 - DNA, 576 bp, Homo sapiens
  misc_feature: GZ8MTXP02FICBC.10.9.A09.1.454.CMB.2.raw
  modified_base (309)..(309): a, c, t, g, unknown or other
  misc_feature (309)..(309): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaagagccaccctctcctgcagggccagtcagaatgttggcgccttcgtaagctggtaccaacacaaacctggccaggctcccaggcccctcatctatggtgcatccaacngggccactggcatcccagccaggttcagtcggcaggtgggtatggggacagtcctcacttctacaccatcatcagtcctggacgcctagaaagactggttgcttagtttacttacgtgtacaactatacgtaaccgaggtcggtaccgtccgggggtcctacgttccggacccgttacggggaaacccgtaaaagggtcggaagtacgtaacgaaaacggaacgttacggacggtacgtcggacacctagtcgtacgtcttactacg

SEQ ID NO: 352935 - DNA, 560 bp, Homo sapiens
  misc_feature: GZ8MTXP02H90J7.10.9.A09.1.454.CMB.2.raw
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (269)..(271): a, c, t, g, unknown or other
  misc_feature (269)..(271): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (278)..(279): a, c, t, g, unknown or other
  misc_feature (278)..(279): n is a, c, g, or t
  modified_base (282)..(282): a, c, t, g, unknown or other
  misc_feature (282)..(282): n is a, c, g, or t
  modified_base (286)..(287): a, c, t, g, unknown or other
  misc_feature (286)..(287): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
tcagcatagtagtgcacgaccggtgctcgatttagcgagacgcgcagggggaggaactctcagttaggacccagagggaaccatggaagccccagctcagcttctcttcctcctgctactctggctcccagtttcagataccaccggagagattgtgttgacacagtctccagccaccctgtctttgtctccaggggaaagagcccaccctctcctgcagggccagtcagatgtgcnctganctgacanacaacngcagcnccagcccnnncangncnncanggcnngcanccagcagtcagtgcagtggtangggacagacttcactctcacctatcatcacgccgtggacgcctaggaagtattgttgactagtttatactgtacaaactattaccgtaccgaggtcggtcccggtcgggggccctacgtttccgggacccgtacggggaaaccgtaaaacgggttcgggaaacgttacgaaaccgtaaaaccggtaaacgtggttacggcgtacggaacctaacccgattcgtcgtttacctttactaccgtccccg

SEQ ID NO: 352936 - DNA, 603 bp, Homo sapiens
  misc_feature: GZ8MTXP02HNWAH.10.9.A09.1.454.CMB.2.raw
  modified_base (205)..(205): a, c, t, g, unknown or other
  misc_feature (205)..(205): n is a, c, g, or t
  modified_base (321)..(321): a, c, t, g, unknown or other
  misc_feature (321)..(321): n is a, c, g, or t
  modified_base (447)..(447): a, c, t, g, unknown or other
  misc_feature (447)..(447): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagcccacctgttctttgtctccgaaggggaaanacgcccaccctctcctgcagggccagtcaagaatggttggcgtccttgtaagctacggtaacccaacaccaaaccgtggacccaggcctcccgacggccccctcatctagtggtcncatcccaaacgacgggcccaacgtggaccactcccgagccctagggttccaggtcggactagggtgggtaatggggacagtccttcacttcaccaaccatcatcacgccgtggacgtctaaaaagngtattggttgactagtttattacgtgttacaactagtaccgtacgaggttccggccgttccgggggcctacgttccggaccgtagggaacctaaggtcggaatacgtaacgaaacgtacgtggtcgcgtcgacaaccgtctcttcgtctttacacg

SEQ ID NO: 352937 - DNA, 690 bp, Homo sapiens
  misc_feature: GZ8MTXP02HQJX8.10.9.A09.1.454.CMB.2.raw
  modified_base (255)..(255): a, c, t, g, unknown or other
  misc_feature (255)..(255): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggaggcgtagtccagcctgggaggtcacagagactctcctgtgcagcctntgggttcaccttcagtagctacggcatgcacgtgggtcccaccaaactcccgaggcaaggggtattgggagtggggtggctagttgtttcatcgtggaggggctaggttgtttacaagttgggtatgacttggaccggtccgggttagggaaacggggtcccgtattaccaaccctacgttcctacccgaagtaacggaacctaaaccgtacccgaaagggaaaccaaactaaagttacgtttaacgttttacgggaaccttaggaaacctacggtacccttaaacggtcccttaggaacgggtacgtaccgggggttagtaacttaacgttacgttagggtaaacgggaaagggggacgggggaacccgagggtacggggtacgttaaccgaaggttaccttccgttacggaccggttacggtcggggtacccg

SEQ ID NO: 352938 - DNA, 613 bp, Homo sapiens
  misc_feature: GZ8MTXP02GPNYK.10.9.A09.1.454.CMB.2.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (376)..(376): a, c, t, g, unknown or other
  misc_feature (376)..(376): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagccgtgggaggtcacagagactctcctgtgcagcctctgggttcaccttcagtagctacggcatgcacgtgggtccnccaaactccgaggcaagggnttgggagtggggtgcgtagttgtttcatcgtggagggctaggttgttacaagttgggtntgctggaccgtccggtagggaacgggccgtattccgaccatccgtaccagaacgaccaacctaccgaaaggaacaactaaattgttaactttacgggacctagaacacgtacctaacgtcgtaggaacggtacgtagggtagtaacttacgtacgttaggaacggaaaggggacgggggaaccgacgggacggtagtaaccgaacgttacctacgttcgacggtcggtcgggtaccg

SEQ ID NO: 352939 - DNA, 527 bp, Homo sapiens
  misc_feature: GZ8MTXP02FHLF1.10.9.A09.1.454.CMB.2.raw
  modified_base (363)..(363): a, c, t, g, unknown or other
  misc_feature (363)..(363): n is a, c, g, or t
  modified_base (519)..(519): a, c, t, g, unknown or other
  misc_feature (519)..(519): n is a, c, g, or t
tcagcatagtagtgcacgaccggtgctcgatttagcgagacgcgcagggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtcccgccaaactccaggcaaggggattggagtggggtggctagtttgttcatctgaggggcagtgttacaatgggtntgctgacgccgtgaagggccgatcaccatctccagagacaactccaggaaacacaatgtatttggacctgaacagacctaagtcctgaggacacgggtgtatactactgtacgaagggagggggaaccagcggagttcgaagtactcttgacgtcnggggtccg

SEQ ID NO: 352940 - DNA, 723 bp, Homo sapiens
  misc_feature: GZ8MTXP02IJJ03.10.9.A09.1.454.CMB.2.raw
  modified_base (314)..(314): a, c, t, g, unknown or other
  misc_feature (314)..(314): n is a, c, g, or t
  modified_base (339)..(339): a, c, t, g, unknown or other
  misc_feature (339)..(339): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggagcgtagtccagccgtgggaggtcacagagactctcctgtgcagcctgtggtcaccttcagtagctacggcatgcacgtcggtccaccaaactccgaggcgaagggnttggaggtgggtgctagttatcctntagtttgagtggaagtaactaaataaatactacaaggtacgtaacccgttccgggttaccgggggacctaactttacccgaaccctactaccctaacccaaaacgtaacctaaagtttacgaaaacgtaaaccgtaacggtaccttagtttaccgtacgtaaccgtaaaacttaggaaaaccgtacggtacccgttaaggaaccgtagacgtagggaaaccgggaaccggtaccgggtacgttgggtttaacgtacgtttttaccggttacggtttttaccgggttttcggtttaccgttacggttacccggttaccggggttaaccgggggttaaacttacccgtttacggaacgtacccggtaacggttccgggggacccgg

SEQ ID NO: 352941 - DNA, 713 bp, Homo sapiens
  misc_feature: GZ8MTXP02GRE6A.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggagcgtagtccagcctgggagtcacagagactctcctgtgcagcctcgtggttcacttcagtagctacggcatgcacgtcgggtccaccaaactccgaggcaaggggattgggagtggggtggcgtaggtttgtttcagttcgtggagggtctaggtcgttacaagttgggttatcggctcggaccgtccggtaggaaacggggtcccgtacgttccaacccgtacgtccgtaccgaagtacgaaccctaaaccgtaccccgaaacgggaaaccaaaccgtaaagttacggtttaaacgttttacgggaacccttacggaaaccgtacgtaacccgttaaacgttacccgtaggaacggtaccgtaacggggtacgttaacgtacgtacgttaggtaaaccggggaaaggggtaacgggggaaaccgacgggtacgggtaacgttaaccgtaaacggttaccgtttacccggttaggtaaccggttccggtcgggggtaaccccgg

SEQ ID NO: 352942 - DNA, 708 bp, Homo sapiens
  misc_feature: GZ8MTXP02JR0JR.10.9.A09.1.454.CMB.2.raw
  modified_base (316)..(316): a, c, t, g, unknown or other
  misc_feature (316)..(316): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggagcgtagtccagcctgggaggtcacagagactctcctgtgcagcctctggttcaccttcagtacgctacggcatcgcacgtgggtcccaccaaactccgaggcaagggnttgggaggtggggtggctaggtttcgtttcagttcgtgggagggctaggttgttacaagttgggtatggactggaccgccggttagggaaacgggtcccgtaacttccaaccctactccgtaccaaggtaacgaacctaaaccgtacccgaaacgggaaaccaacgtaaaagttacggtttaaacgttttacgggaaccgttaggaaaccgtaacgtaacccgttaaacggtcccgtagggaaacggtaccgtaaccgggggttataacgttaccgttaacgtacgggtaaacgggaaacgggggaacgggggaaaccgacggggaccgggtaacgttaaccgtaaacggttaccgttaccgttacggtaccggttcggtacggggtaccgg

SEQ ID NO: 352943 - DNA, 571 bp, Homo sapiens
  misc_feature: GZ8MTXP02G30ME.10.9.A09.1.454.CMB.2.raw
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaatggtggagtcgtgggggagcgtagtccagcctgggaggtcacagagactctcctgtgcagcctcgtgggttccaccttcagtagctacggcatgcacgtgggtccaccaaactccgaggcaaaggggattgggagtggggtgctagtttgttcatcgtgagggcagtgttcaagtggtatgctgacgccgtgaacgggccgatcacatcncagacgacaacncaagaacacaatntattcgactagaacagacctaagtcctaggacggacgacggggtataactacgtacgtaggtaaacggaaaggggacgggggaaccacgggacggaacgtaaccgaaagtaccgttcgttacggacggtcggtaacgggtacccgg

SEQ ID NO: 352944 - DNA, 621 bp, Homo sapiens
  misc_feature: GZ8MTXP02F0O3M.10.9.A09.1.454.CMB.2.raw
  modified_base (372)..(372): a, c, t, g, unknown or other
  misc_feature (372)..(372): n is a, c, g, or t
  modified_base (505)..(505): a, c, t, g, unknown or other
  misc_feature (505)..(505): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggagcgtagtccagcctgggagtcacagagactctcctgtgcagcctcgtgggttcaccttcagtagctacggcatgcacgtcgggtcccaccaaactccgaggacaagggattgggagtgggtgctagtttgttcatcgtggaggcagttgttacaagttgggtntgcttggaccgccggtaggaacgggccgtattccaccgatcctaccaagacgaccaactccgaaggaaacacaaagttgtaatttcggacctagaaacacgtacctaagtccgtaggaacggacgtacgggtntaactacgtacgtaggtaaacggaaacgggggaacgggggaaacccgagggccgggtaaacgttaaccgtaaaggttaccttaccgtttaggaccggttcggtacggggtacccgg

SEQ ID NO: 352945 - DNA, 760 bp, Homo sapiens
  misc_feature: GZ8MTXP02JJJ5X.10.9.A09.1.454.CMB.2.raw
  modified_base (318)..(318): a, c, t, g, unknown or other
  misc_feature (318)..(318): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagcctgggagtcacagagactctcctgtgcagcctcgtggttcaccttcagtagctacggcatgcacgtcgggtcccaccaaactccgaggcgaagggtnttgggagtggggtgcgtaggtttgtttcagttcgtaggagggtctaggttcgtttacgaaagttgggttatgccgttacggaccgccgggttaggaaaccggggtcccgtaacttacccgaaccctacgtccgtaaccgaagaaacgaaccgaaacctacccgaaagggaaaccaaacgtaaagttcgttaaacgtttacggaacccgttaggaaaaccgtaacggtaacccgttaaaacggtcccgtaagggtaacggaaccggtaacggggttacgtaacgttaaccgttaacggtaacgggttaaaccggggaaaacgggggtaaaccggggggtaaaccgaacggggtaccggggtaaacggttaacccgtaaaacggtttacccggttaccgtttacgggtaaccggtttaccggggtaccgggggttaaccccggg

SEQ ID NO: 352946 - DNA, 743 bp, Homo sapiens
  misc_feature: GZ8MTXP02GVR35.10.9.A09.1.454.CMB.2.raw
  modified_base (257)..(257): a, c, t, g, unknown or other
  misc_feature (257)..(257): n is a, c, g, or t
  modified_base (358)..(358): a, c, t, g, unknown or other
  misc_feature (358)..(358): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggaggcgtagtccagccgtgggaggtcacagagactctcctgtgcagcctntggttccaccttcagtagctacggcatgcacgtcgggtcccacccaaactccgaggacgaaggggattgggaggtggggtggctagtttgtttcagttcgnggagggctaggttgttacaagttggtatcggctcggaccgtccggtaaggaaacggggtcccgtaacttaccaaccctactaccgtaccgaaagaacgaaccctaaaccgtacccgaaaacggaaacctaaactaaagttacggttaacgtttaccggaacccgttaaggaaaaccgtaacggtaacccgttaaacggtacccgtaaggtaaccggggaaccgtacgggggttaactaacgttaaccgttaacggtacgggtaaaacgggaaaacgggggtaacgggggaaaaccgaacggggtaccggggtaaacggttaacccgaaaacggttaccgttacccggttacggtaccgggttaccgggtacgggggtaccccggg

SEQ ID NO: 352947 - DNA, 664 bp, Homo sapiens
  misc_feature: GZ8MTXP02HBM3B.10.9.A09.1.454.CMB.2.raw
  modified_base (319)..(319): a, c, t, g, unknown or other
  misc_feature (319)..(319): n is a, c, g, or t
  modified_base (350)..(350): a, c, t, g, unknown or other
  misc_feature (350)..(350): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagcctgggagtcacagagactctcctgtgcagtcctcgtggtacaccttcagtagctacggcagtgcacgtcgggtcccaccaaactccgaggcaagggnttgggagtggggtgctaggttgttcagtcgnggaggctagtcgttacaagttggtatgctggaccgtccgtaggaacgggccgtattcacctatcctccagacgaccaaccgtaccgaagaaccaacgtaattacgttaagtttacgggaaccttaggaaacctaacggtacccttaaacggtcccgtagggaacggtaaccggtaacggggttagttaacgttaaccgtacggtacgggtaaaccggtaaagggggaacgggggaaccgacggggaccggggttaacgttaaccgaaacggttaccgttaccgttaggaccggttccggttacgggggacccgg

SEQ ID NO: 352948 - DNA, 613 bp, Homo sapiens
  misc_feature: GZ8MTXP02FQKNR.10.9.A09.1.454.CMB.2.raw
  modified_base (387)..(387): a, c, t, g, unknown or other
  misc_feature (387)..(387): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagccgtgggagtcacagagactctcctgtgcagtcctcgtggttcaccttcagtagctacggcatcgcacgtcgggtcccaccaaacgtccgaggacgaaggggtattggggaggtggggtgctagtttgttcagtcgtggaggggctaggttgttacaagttgggtngcgtgaccgtccgtaggaacgggccgtattcacatctacagacacaactcgaagaacacaattcgtattcggaacctgaacacgtacctaaagtccgtaggacggtacgacgggtagtaatacgtaacgtaggtaaacggaaaggggaacgggggaaccgagggcgggtaacgttaaccggaaagttaccgttaccgttaggtaccggtacggtacggggtacccg

SEQ ID NO: 352949 - DNA, 607 bp, Homo sapiens
  misc_feature: GZ8MTXP02G2U0Z.10.9.A09.1.454.CMB.2.raw
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagcccaccctgtctttgtctccaggggaaangcccaccctctcctgcagggccagtcagatgttggctcttgaanctggtaccaacacaaactggccaggcctcccaggcccctnatctatggtgcatccaacgngggcccactggccatccccagcctaggtcaggtcggcaggtgggtatgggacagcttcactctacaccatcatcagcctaggcgcctgaagtatgttagacttagtttacttacgtagtactaacgtacttaccggtaccgtaacggtccggtacccggtcccggggggtaccctaaccggttttcccggcccggttacggggaacccgtaaaacgggtcgggaaactacggtaaccaaaacggtacgtacggttacggctaacgacctaccgtacttccgtacgttaccttacgtaccc

SEQ ID NO: 352950 - DNA, 744 bp, Homo sapiens
  misc_feature: GZ8MTXP02H3U82.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggaggcgtagtccagccgtgggaggtcacagagactctcctgtgcagcctcgtgggttccaccttcagtagctacggcatgctacgtcgggtcccaccaaactccgaggacgaaaggggtattgggaggtggggtggctaggtttgtttcagttcgtaggagggctaggtgttacaagttggtagtgctcggaccgccggttagggaacgggtcccgtattaccgacctaacgtccctaccgaagtaacgaaccgtaaaccgtacccgaaagggtaaacctaacgtaaagttacggtttaacgtttacgggtaaacccttacggaaaccgtacggtaaccgttaaacggtaccccgttaagggaaccgggtaaccgtaacgggggtttagtaaaacgtttaaccgtaacgttaacgggtaaaacgggaaaacgggggtaaacgggggaaaacccgacggggtaacggggtaacggtttaacccgtaacggttaaccgtttcccggtttaggacccggtttacgggttacgggggacccg

SEQ ID NO: 352951 - DNA, 727 bp, Homo sapiens
  misc_feature: GZ8MTXP02HRGAZ.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggaggtcacagagactctcctgtgcagcctctgggttcaccttcagtagctacggcatgcacgtggtcccgccaaactcccgaggcaaggggattgggagtgggtgctagtttgttcagtctggaggggctaggtgtttacaagttgggttatggctcggacgccgttagggaaaggggtcccgtagtttccaccctactaccgtacccgaagacgtaaaccaaaccgttacccgaaaggggaaaccctaaacgtaaacttacggtttaaacggttttacgggtaaacccgttaggaaaaccgtacggtacccgttaaaacggttcccgttaggggaacgggaacccggtaacggggtttagtaacttaaccgttaacgtacgggttaaaacgggtaaacgggggaaacggggggaaacccgacggggtaaccggggacggtttaacccgaaaggttacccgttccgtttacgggaccggtttccgggtcgggggtaaccccgg

SEQ ID NO: 352952 - DNA, 492 bp, Homo sapiens
  misc_feature: GZ8MTXP02I756Q.10.9.A09.1.454.CMB.2.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
  modified_base (380)..(380): a, c, t, g, unknown or other
  misc_feature (380)..(380): n is a, c, g, or t
  modified_base (456)..(456): a, c, t, g, unknown or other
  misc_feature (456)..(456): n is a, c, g, or t
  modified_base (470)..(470): a, c, t, g, unknown or other
  misc_feature (470)..(470): n is a, c, g, or t
tcagcatagtagtgcacgaccggtgctcgatttagcgagacgcgcagggggaggaactgctcagttaggacccagagggaaccatggaagccccagctcagcttctcttcttcctgctactctggctcccagtttcagataccaccggagagattgtgttgacacagtctccagcccaccctgttctttgtctccaaggggaaangcccaccctctcctgcaggccagtcagatgtgcncttgtagctgaccaanacaacngcagcnccagccctnatctatggtncatccaacgnggccagtggcatcccagccaggtcagtcggcagtgggtangggacngcttcactctacaccatcatcancctggagctagagtntgtgactagttattactgtacaactatacgtacgagtcgccgtccggggcctacgttcggccgtggacaaggtgantacaacgacgtcgngctgacgactatctctctctac

SEQ ID NO: 352953 - DNA, 540 bp, Homo sapiens
  misc_feature: GZ8MTXP02F6B0D.10.9.A09.1.454.CMB.2.raw
  modified_base (316)..(316): a, c, t, g, unknown or other
  misc_feature (316)..(316): n is a, c, g, or t
  modified_base (416)..(416): a, c, t, g, unknown or other
  misc_feature (416)..(416): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggaggcgtagtccagcctgggagtcacagagactctcctgtgcagcctcgtggttcaccttcagtagctacggcatgcacgtggtcccgaccaaactccaggcaaagggnttggagtgggtgctagttgttcatcgtgagggcagtgttacaagtggtatgctgacgccgtagaaggccgatcaccatcacagagacaactacagaacanaaatgtattgacctgaacagacctaagtctagagacgacgggtataatactacgtagaacggaaagggacgggggaaccaggcggtaagtaaccgtaagtactccttgacgtcgcgggtacccg

SEQ ID NO: 352954 - DNA, 514 bp, Homo sapiens
  misc_feature: GZ8MTXP02F6GG4.10.9.A09.1.454.CMB.2.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (361)..(361): a, c, t, g, unknown or other
  misc_feature (361)..(361): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcaggccagtcagatgtgcnctgagctgacancaacngcagctccagccctnatcatggtncatccaacngggccagtggcatcccagccaggttcagtcgcagtggtatgggacagcttcactctcacatcatcagcctggacnctagaagattgtcgatagtttattactgtacaacgtatcgtacggagtcggccgttccgggggcctacgtttccggcccgtgggaaccaaaggtcgagacgtacgaaaacgactacggtcggactggaccaccgtatccgtcgtccttctacg

SEQ ID NO: 352955 - DNA, 674 bp, Homo sapiens
  misc_feature: GZ8MTXP02JOXKS.10.9.A09.1.454.CMB.2.raw
  modified_base (317)..(317): a, c, t, g, unknown or other
  misc_feature (317)..(317): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggagcgtagtccagccgtggggagtcacgagagactctcctgtgcagcctgtggttcaccttcagtacgctacggcatgcacgtcggtccaccaaactccgaggcaagggnttgggagtggggtcggctaggtttcgtttcagttcgtaggacggggtctaggttcgttacgaagttgggtatcgacgtgggaacccgtccggtaagggaaaccggggtccctaagttcccgaaacctactcccgtaccaaggaacgtaacctaaccgtaccgaaacggaacaaccgtaaagttacgttaagttacggaccttacgaacgtaacgtaccgtaacgtccgtaggaacggtacggtacggtagtaacgtactacgtaggtaacgggaaaggggaacgggggaccgacgggacggtacgttaaccgaacgttaccgtccggttacgacggttaccggtacggggtacccgg

SEQ ID NO: 352956 - DNA, 694 bp, Homo sapiens
  misc_feature: GZ8MTXP02HXHOD.10.9.A09.1.454.CMB.2.raw
  modified_base (317)..(317): a, c, t, g, unknown or other
  misc_feature (317)..(317): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagccgtggggagtcacagagactctctgtgcagactcgtggttcaccttcagtagctacggcatgcacgtgggccaccaaactccgaggacaaaggggtnttggggagtgggtggctaggtttgtttcattcgtaggagggctaggttagttcaaagttgggttatgctaggaccggtaccgtagggaaacgggcccgtattaccaaccctacttcctaccgaagaacgaacctaaaccgtacccgaaagggaaaccaaactaaagtttacggttacgttttacgggaaccttacgaaaccgtacgtaccctaaacgtcccgtaaggaacggtaaccgaacggggtattaacgtaacgttacgttaagggtaaaccggaaagggggaaacgggggaaaccgaggggaccggggtaacgttaacccgtaaggttacccgttaccgtttacggtaccgttccggtacgggggtacccgg

SEQ ID NO: 352957 - DNA, 593 bp, Homo sapiens
  misc_feature: GZ8MTXP02J1B6Y.10.9.A09.1.454.CMB.2.raw
  modified_base (321)..(321): a, c, t, g, unknown or other
  misc_feature (321)..(321): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggaggcgtagtccagcctggggaggtcacagagactctcctgtgcagcctcgtgggttcaccttcagtagctatggcatgcacgtcgggtcccaccaaactccgaggcgaagggnttgggagtggggtgctagtttgttcagtccgtggaggggctaggttgttacgaagttggtatgctgaccgcggtaggaacgggcctagttcaccgatcctccagacgacaacaccgagaacacaatgtattgacctagaacacgacctaaagtcccgtaggtacggacgacgggttagtactacgtacgacggtaaacggaacggggaacgggggaaccgagggacggtaacgtacccgaagttaccgttcgttacgtaccggtcgtcgggg

SEQ ID NO: 352958 - DNA, 572 bp, Homo sapiens
  misc_feature: GZ8MTXP02JJNEQ.10.9.A09.1.454.CMB.2.raw
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (363)..(363): a, c, t, g, unknown or other
  misc_feature (363)..(363): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggaggcgtagtccagcctgggaggtcacagagactctcctgtgcagactctgggttcaccttcagtagctacggcatgcacgtgggtccnccaaactccaggcaagggnttgggagtgggtggcagtttgttcatctggagggcagtgttcaagtggtntgctggacgcgtgaaggcatcacatctcagagaccaactccaagacacaatgttaattggacctagaactagaccttaagtcctaggacggaccgtacgggtagtaactacgtacgtaggtaaaccggaaaggggacgggggaaccaacgggacgggaacgttaaccgaaggttaccgttccgttaggaccgtcggtacggggtacccg

SEQ ID NO: 352959 - DNA, 666 bp, Homo sapiens
  misc_feature: GZ8MTXP02HL1ZO.10.9.A09.1.454.CMB.2.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (319)..(319): a, c, t, g, unknown or other
  misc_feature (319)..(319): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagcccacctgtctttgctccgaggggaancgccaccctctcctgcagggccagtcagatgtgcnctganctgacanacaacngcagctccagccctnatctagtgncataccaacgnggccagtggccactcccgagccgtaggtcnggtccggctaggtgggtatgggacagcttcactcaccacatcatcgagtccgtggacgtaccgtaggaacgtagtttggttacgtacgttaacggttttaacttacgttacggttaaaccaaaccggttacgttacccgggtaaccgggttaacgggttcccggggtcccccgggttacccggggggtacccttaacccgggtttcccggggaccccggtacggggtaaaccccggtaaagggttccgggaaacggtaaccgtaaacgtaaaaccggtacgttacgggtccggaacgttaaccggacctaacgttacgttacgttcccgttaccgtttaactccccg

SEQ ID NO: 352960 - DNA, 672 bp, Homo sapiens
  misc_feature: GZ8MTXP02JRS3I.10.9.A09.1.454.CMB.2.raw
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggaggcgtagtccagcctgggaggtcacagagactctcctgtgcagcctcgtgggttcaccttcagtacgctacggcatgcacgtcgggtcccaccaaacgtccgagggacaaaggggtagtttggggaaggttggggtggtctaggtttgtttcatcgtggaggtcaggttcgttcaagttgggtatgcgtgaccgccggtaggaacggggccctattccaaccgtatcctaccaagaacgacctaaacctaccaaaggaaacaaccgtaaagttgttaagtttcggaaccttacgaaaccgaacgtaccctaaggtccctagggacgtacggtaacgggtagtaacttaccgtacgtagggtaaccgggaaagggggacgggggtaaccgaacggggtacgggaacggttaaccgaacggttaccgttaccgtttacggaccggttccgggtacggggtacccgg

SEQ ID NO: 352961 - DNA, 741 bp, Homo sapiens
  misc_feature: GZ8MTXP02IDYIU.10.9.A09.1.454.CMB.2.raw
  modified_base (363)..(363): a, c, t, g, unknown or other
  misc_feature (363)..(363): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggaggcgtagtccagccgtgggaggtcacagagactctcctgtgcagcctcgtggttcaccttcagtagctacggcatgcacgtcgggtcccacccaaaacctccgaggcgaaaggggagtttaggggaggtgggtggtcgtagtttgtttcattcgnggagggctaggtgttactaagttggttatggtctacggacgtcccggtagggaaacggtccgtattccgacctactcccgtacgaagacaaccgaacctacccgaaacgggaaacctaaccgtaaaagtttacggttaaacgtttacgggtaaacccgttaaggaaacccgtaccggtaacccgttaaacggttacccgtacgggtaaaccgggtaaccggtaaccggggtaagttaaacgttaaccgtaacgttacggggtaaaccgggtaaaacgggggaaacggggggaaacccgacggggtaaccggtaacgttaacccggtaaacgttacccgttaccggtttacggtaccggtacggtacggggtaccccgg

SEQ ID NO: 352962 - DNA, 726 bp, Homo sapiens
  misc_feature: GZ8MTXP02INH5X.10.9.A09.1.454.CMB.2.raw
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagccgtgggagtcacagagactctcctgtgcagcctcgtgggtccaccttcagtacgctacggcatgccacgtcgggtccccaccaaactccgaggacgaaggggtattgggaggttggggtggctaggtttcgttcagttcgtaggagggtctagttgttacaagttggtatcgcgtacggaccgtccggtagggaaacgggtccgtaattcccgaaacctacgtccgtaccgaagaaacgaacctaaaccgtaccgaaacggaaaccaacgtaaacgttaggttacgtttacggacctaacgaacgtacgtaacccgtaaagtcccgtaagggaacggtaaccggtaacgggttacgtaaacgttaaccgtaacggttacgggaaacgggaaaacgggggaaaccgggggaaaccgtacggggtaaccgggggtaacgttaacccggaaacggtttaccgttacccggtttacggtacccggtttcgggtaccgggggtaccccgg

SEQ ID NO: 352963 - DNA, 570 bp, Homo sapiens
  misc_feature: GZ8MTXP02HMZ4W.10.9.A09.1.454.CMB.2.raw
  modified_base (239)..(239): a, c, t, g, unknown or other
  misc_feature (239)..(239): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
tcagcatagtagtgcacgaccggtgctcgatttagcgagacgcgcagggggaggaactctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcncctcgtaagctggtaccaacacaaactggccaggctcccgaggcccctcatctatggtncatccaagngggccactggcatcccagcaggttcagtgcaggtggtatgggacagacttcactctacaccatcatcagctgganctagaagntgtgactagtttatacgtgtacaactattcgtacgagggtcggcccggtccgggggcctacggtttccgggcccgttacggggaaccaaaagggttcgggaacgtaagtaaccgaaaacggtaacctggtacgggctggaaccgacctacgttccgttacgttccttactactttccccg

SEQ ID NO: 352964 - DNA, 595 bp, Homo sapiens
  misc_feature: GZ8MTXP02F4WYU.10.9.A09.1.454.CMB.2.raw
  modified_base (313)..(313): a, c, t, g, unknown or other
  misc_feature (313)..(313): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtcccaccaaactccaggcaagggnttgggagtgggtgctagttgttcatctgaggcagtgttcaatggtatgcgtgaccgccggtaggaacgggccgtattcgatcatctaccagacgacaactaccaacggaacaacaatagttagtttacggacctagaacacgtacctaacgtccgtagacggaacgacgggtagtacgtactacgtaggtaaaccgggaaaggggtacgggggaaaccgaggacggggtaagttaccgaaacggttaccgttaccgtttacggaccggttacggtacggggg

SEQ ID NO: 352965 - DNA, 806 bp, Homo sapiens
  misc_feature: GZ8MTXP02JT3YB.10.9.A09.1.454.CMB.2.raw
  modified_base (270)..(270): a, c, t, g, unknown or other
  misc_feature (270)..(270): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggaggcgtagtccagccgtgggaggtcacagagactctcctgtgcagcctcgtgggttcaccttnagtagctacggcatcgctacgtcgggtaccgacccaaacgtcccgaggaccgaaaggggtagttaggggaggttggggtacggtcgtaggttttcgtttcagttcgtagggacggggtcgtaggttaggttacgtaaaggttggttagtgtccggtacggtacccgggtaccggttaggggaaaccggggtcccgtaacgtttacccgaacccgtactcccgtacccgaacgaacggaaccctaaacccgtaccgaaacgggtaaacctaaacgtaaacgtttacggtttaacgtttaccgggtaaccgttaaaccggaaacgtaaaccgttaacccgtaaacggttaccggtaacggtaacggggtaaccgtaacgggggttacttaaaacgttaaccgtacggttacgggggtaaacgggaaaacggggggtaaacgggggaaacccgtacgggggaacggggtaccgtaaccggtaaacgttaccgttaccggtttagggtacccggttacggggtaccggggtaaccccggg

SEQ ID NO: 352966 - DNA, 674 bp, Homo sapiens
  misc_feature: GZ8MTXP02GKKLA.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggatgcgtagtccagccgtggggagtcacagagactctcctgtgcacgcctcgtgggttcaccttcagtacgctacggcatgcacgtcgggtcccaccaaactccgaggacgaagggtattgggaggtggggtggctagtttgtttcagtccgtggagggtctaggttgttacgtaagttcgggtatcggcgttaggaccggtccggtagggaacggggccgtattaccaccgtactaccgtaccgaagaccgaaaccaaccgtaccgaaacggtaaaccaaacgtaaagttacgtttacgtttacggaaccttacgaaaccgtacgtaaccgtaacgtccgtagacggtacgtacggttagtactaactacgtacgggtaaacgggaaacggggaacgggggtaacgacgggacgggtaacgttaccgaacgttaccgttacgttacggtaccggtacggtaccgggg

SEQ ID NO: 352967 - DNA, 579 bp, Homo sapiens
  misc_feature: GZ8MTXP02JDH0S.10.9.A09.1.454.CMB.2.raw
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggagcgtagtccagcctgggagtcacagagactctcctgtgcagcctctgggttcaccttcagtagctacggcatgcactgggtccncaaactccaggcaagggnttgggagtgggtgctagttgttcatctggaggctagtgttcaagtgtngctgacgcgtgaacggcatcacntcncaganacactcagacacaatgtattcgactgaacacgacctaagtccgtagacggtacgtacggggtactaacgtaccgtacgtacgggtaacgggaaacgggggaacgggggtaaccacggggtaccggggtaacgttaaccgtaaacggttaccgttaccgtttacggaccggttacggtacggggtaacccgg

SEQ ID NO: 352968 - DNA, 684 bp, Homo sapiens
  misc_feature: GZ8MTXP02HRAVU.10.9.A09.1.454.CMB.2.raw
  modified_base (171)..(171): a, c, t, g, unknown or other
  misc_feature (171)..(171): n is a, c, g, or t
  modified_base (261)..(261): a, c, t, g, unknown or other
  misc_feature (261)..(261): n is a, c, g, or t
  modified_base (385)..(385): a, c, t, g, unknown or other
  misc_feature (385)..(385): n is a, c, g, or t
tcagcatagtagtgcacgaccggtgctcgatttagcgagacgcgcgagggggggagaggagcccagcactagaagtcggcggtgtttccattcggtgatcagcactgaacacagaggactcaccatggagtctgggctgaacttgggttttcctcgttgcttcttttaagnggtgtccagtgtcaagtgcaactggtggagtcgtgggggagcgtagtccagccgtggggaggtcacagagactctcctgtgcagtccctntgggttccaccttcagtacgctacggcatgcacgtcggggtccccaccaaacctccgaggacaaggggtattgggaggttcggggtggctaggtttgttcagtcgtggaggtctagttcgttanaagttggtatgcttggaccgtccggtaggaacgggtccattccactatctaccgagacaccaactacccgaaggaaacaacgtaaagttagtttactttacgggaaccttacggaaaaccgtacgtacccgtaaacggtcccgtagggacggtaaccgttaacgggggtattaacgttaaccgtacgttacgggaaaccggggaaagggggaaccgggggaacgacgggtaacgggtaacgtaaccgtaaacggttacccgttcgttaacgggtccggttacggttacggggtacccgg

SEQ ID NO: 352969 - DNA, 666 bp, Homo sapiens
  misc_feature: GZ8MTXP02F9OO1.10.9.A09.1.454.CMB.2.raw
tcagcatagtagtgcacgaccggtgctcgatttagcgagacgcgcagggggggagaggagcccagcactagaagtcggcggtgtttccattcggtgatcaacactgaacacagaggactcaccatggagtctgggctgaactgggttttcctcgttgctcttttaagaggtgtccagtgtcaagtgcaactggtggagtcgtgggggagcgtagtccagccgtgggaggtcacagagactctcctgtgcagcctcgtgggttcaccttcagtagctacggcatgcacgtgggtcccgaccaaactccgaggcaaggggtatgggaggtggggtggctagtttgttcagtcgtggacggcagttgttacaatggtatcgctcggaccggccgtagggaacggggcctattaccgacctatccgtaccaggaacgtaaccaaccgtaccgaaacggaaaccaacgtaattacgttaagtttacgggaaccttagaaactaaggtaccctaaacgtccgtaggaacggaacgtacggggttataacgttaacgtaacgtacggtaaacgggaaacgggggaacgggggaaccgacgggtacgggtacgttaccgaaacggttaccttacggtttacgaccggttacggtccgggggaccgtaaccgggg

SEQ ID NO: 352970 - DNA, 742 bp, Homo sapiens
  misc_feature: GZ8MTXP02JVESQ.10.9.A09.1.454.CMB.2.raw
tcagcatagtagtgcacgaccggtgctcgatttagcgagacgcgcgagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggaggtcacagagactctcctgtgcagcctctgggttcaccttcagtagctacggcatgctactcgggtccaccaaacgtccaggcaaggggattggggacgtggggtggcgtaggtttgtttcagttccgtagggacggggctaaggttgtttacaaagttgggttactgggtacgttagggaaccgtcccggttaggggaaaccggggtcccgtacgtttaccaacccgtaacttacccgtaccgaacggaaacgaaccgtaaaccgttacccgaaacgggtaaaccaaacctaaagttacggttaaacgttttacgggaaccttacggaaacgtaacgtaacccgtaaacggtcccgtaaggaacggtacggtaaccgggtgtaacgttactacgttacggtaaacgggaaaacggggacgggggaaacccacgggggtacggggtaacggttaaccgtaaacggttacccgttaccggtttacggtaccggttacgggtacgggggtaacccgg

SEQ ID NO: 352971 - DNA, 634 bp, Homo sapiens
  misc_feature: GZ8MTXP02G5Q2H.10.9.A09.1.454.CMB.2.raw
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (322)..(322): a, c, t, g, unknown or other
  misc_feature (322)..(322): n is a, c, g, or t
  modified_base (368)..(368): a, c, t, g, unknown or other
  misc_feature (368)..(368): n is a, c, g, or t
tcagcatagtagtgcacgaccggtgctcgatttagcgagacgcgcagggggggagaggagcccagcactagaagtcggcggtgtttccattcggtgatcagcactgaacacagaggactcactatggagtctgggctgaacttgggttttcctcgttgcttcttttaagaggtgtccagtgtcaagtgcaactggtggagtcgtgggggagcgtagtccagccgtgggagtcacgagagactctccngtgcagtcctgtggtcaccttnagtagctacgcatgcacgtcgggtaccccaccaaactccgaggcgaaagggtnttgggaggtgggtgcgtagttgtttcagttcgaggagggctaggtnttacgtaaagtgggtatcgacgtggaccgtcgtaggacgggtcccattccacctatctaccagacacaacgtacgaaagaacctagaaagtcgttaacgtttcggaactacgaaactacgtaccctaaaggttccgtagaaacggacgtacgggtataacctaacgttacgaggtaacgggaaaggggaacggggaaccgaggaccggttaacaacccgtaaggttacccttcgtttaggaccggtttcgggcggggttaacccgg

SEQ ID NO: 352972 - DNA, 782 bp, Homo sapiens
  misc_feature: GZ8MTXP02IJ8U3.10.9.A09.1.454.CMB.2.raw
  modified_base (321)..(321): a, c, t, g, unknown or other
  misc_feature (321)..(321): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggaggcgtagtccagcctgggaggtcacagagactctcctgtgcagcctcgtgggttcaccttcagtagctacggcatcgcacgtcgggtcccaccaaactccgaggcaagggtnttgggaggtggggtgctaggttgtttcagtcgtggagggctagttgttacaagttggtatgcgtggaccggtccggtagggaaacgggtcccgtaacgttaccgaccctacgttcctacccgaaggaacgaaccaaaccgtacccgaaagggaaaccaacgttaaacgtttacggttaacgttttacggggaacccgttacggaaaccgtaaaccggtacccgttaaacggttaccccgttagggaaacggggtaaccggtaaccgggggttaacgttaaacgttaaaccggttaacggttaacgggggtaaaaccgggggtaaaacggggggaaaccgggggggtaaaacccgtaacgggggtaccgggggttaaacggtttaaccccggtaaaacggtttacccgttacccgggtttacgggtaacccgggtttccggggtaccgggggtaaccccggg

SEQ ID NO: 352973 - DNA, 637 bp, Homo sapiens
  misc_feature: GZ8MTXP02J17C4.10.9.A09.1.454.CMB.2.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgttctttgtctccgaggggaaanagcccaccctctcctgcgagggccagtcagtaatgttggcncttacgaagctacgtacaacacaacgtgccaggctccacgccctnatctatggtnacactaccaacgacgggcctacgtcggaccaactccccagtccgtaggtccgaggtccggacgtaggtgggtaagtgggaacagtccttcaccttaccncaccagtcaatcaacggcctggaacnctagagtattggtanacttagtttatacgtactaactaacgacgttcggtaaccgggcgtccgggtcccggttacccgggggaacttccggtttcccgggacgtacgggggaaaacctaaggggtacgggaaactaaccgtaaaacgaaaacggtacgtcggtacgtaccgtcgaaccctaccgttacgtccgttcgttaccttaccgaccc

SEQ ID NO: 352974 - DNA, 604 bp, Homo sapiens
  misc_feature: GZ8MTXP02HUQNO.10.9.A09.1.454.CMB.2.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (366)..(366): a, c, t, g, unknown or other
  misc_feature (366)..(366): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccgaagggggaaagcgccaccctctcctgcagggccagtcagatgtgcncttgagntgacanacaacngcagcnccagcccnatctatggncanccaagcggcagtcgcactccagcctaggtcaggtcgcgagtggatggacagcttcactctccacatcatcagcctaggacnctagaagtagttgttacgacgttagtttactaacgttgtaactaactagtaccggtacggacgttccgggacccggttaccgggggtaccttaccgggtttcccgggacccggtacggggaaacccgtaaaagggtacgggtaaacgtaacgttaaaccggaaacgtaaaccggtcggtaacgggtctaacggtaccaaaccgttcttaccgtttacggttaccttttaccgtacccg

SEQ ID NO: 352975 - DNA, 716 bp, Homo sapiens
  misc_feature: GZ8MTXP02HMMH1.10.9.A09.1.454.CMB.2.raw
  modified_base (167)..(167): a, c, t, g, unknown or other
  misc_feature (167)..(167): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (352)..(352): a, c, t, g, unknown or other
  misc_feature (352)..(352): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagnggtgtccagtgtcaagtgcaactggtggagtcgtgggggagcgtagtccagccgtgggagtcacagagactctcctgtgcagcctcgtggttccaccttnagtacgctacggcagtcgcacgtcggtcccaccaaactccgaggcgaagggtnttgggagtgggtgctagtttgtttcagttcgnggagggtctaggtgttacaaagttgggtatggcgtcggaccgtccggtaggaaacggggtcccgtaacgttccaaaccctacgtacccgtaccgaagaacgaacccgtaaacccgttaccgaaagggtaaaccctaacgtaaagttcggtttaaacgtttcgggaaccgttacggaaaccgtacgtaacccgttaaaggttacccgtagggaacgggtaacgtacggggttagtaacgttaacgtacgtagggttaaaccgggaaagggggaccgggggtaaccgacgggtaccgggtaacggtttaacccgaaacggtttaccgttccgtttaagggaccggttacggtacgggggtacccgg

SEQ ID NO: 352976 - DNA, 499 bp, Homo sapiens
  misc_feature: GZ8MTXP02HQX4U.10.9.A09.1.454.CMB.2.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (269)..(270): a, c, t, g, unknown or other
  misc_feature (269)..(270): n is a, c, g, or t
  modified_base (272)..(273): a, c, t, g, unknown or other
  misc_feature (272)..(273): n is a, c, g, or t
  modified_base (275)..(276): a, c, t, g, unknown or other
  misc_feature (275)..(276): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (284)..(285): a, c, t, g, unknown or other
  misc_feature (284)..(285): n is a, c, g, or t
  modified_base (289)..(289): a, c, t, g, unknown or other
  misc_feature (289)..(289): n is a, c, g, or t
  modified_base (291)..(292): a, c, t, g, unknown or other
  misc_feature (291)..(292): n is a, c, g, or t
  modified_base (294)..(294): a, c, t, g, unknown or other
  misc_feature (294)..(294): n is a, c, g, or t
  modified_base (302)..(303): a, c, t, g, unknown or other
  misc_feature (302)..(303): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (327)..(328): a, c, t, g, unknown or other
  misc_feature (327)..(328): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccacctgtctttgctccgaggggaaanagccacctctcctgcaggccagtcagatgtgcncttganctgtacanacaacngcagctccagccctnntnngnnancangcnngcancnncngtcagcgnngtganggacagtctnactcncacnncancagctganctagatntgtnattattatatntactaactagtacgtacgngtcggtccggtccgggacctacggttccggaccgtacgggaaccgtaaaggtacggtaagaacgtaacgaaaacgtacgtcggtacgactaacgacactactcgttacgtacttactac

SEQ ID NO: 352977 - DNA, 842 bp, Homo sapiens
  misc_feature: GZ8MTXP02JQLEM.10.9.A09.1.454.CMB.2.raw
tcagcatagtagtgcacgaccggtgctcgatttagcgagacgcgcagggggggagaggagcccagcactagaagtcggcggtgtttccattcggtgatcaacactgaacacagaggactcaccatggagtctgggctgaacttgggttttcctcgttgcttcttttaagaggtgtccagtgtcaagtgcaactggtggagtcgtgggggagcgtagtccagccgtggggaggtcacgagagtactctcctgtgcagtcctcgtggttccaccttcagtacgctacggcagtcgcacgtcgggtaccccaccaaactccgagggtacgaaggggtattggggacggttggggtggtaccgttaggtttttacgtttccgaagtttccggtaggtacggggtccttagggtttgttaaccgtaaggttagggttagtcgggtccgttaggggaaccccggtcggggttaggggaacggggtccgtaacttacccgacctacgttaccacccgaagaaccgaaaccacccgtaccggaaacggtaaccacgttaaagttcggttacgtttaccggaaaccgttagaaaacccgtacggttaaacccgttaaccggttacccggtaagggtaaaccgggtacggttaaaccgggggtttagtaaaccgttaaaccggttaaccgggttacgggggtaaaccgggggtaaaacggggggaacccgggggttaaaccgacgggggtaacccgggggttaacgttacccgtaaaccggtttaacccggtttccggtttacgggaccggtttaccggggtacccgggggtacccggtttaaccccggggg

SEQ ID NO: 352978 - DNA, 635 bp, Homo sapiens
  misc_feature: GZ8MTXP02F0HH0.10.9.A09.1.454.CMB.2.raw
  modified_base (319)..(319): a, c, t, g, unknown or other
  misc_feature (319)..(319): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggaggcgtagtccagccgtgggagtcacagagactctcctgtgcagcctcgtgggttcaccttcagtagctacggcatgcactcgggtccaccaaactccgaggacgaagggtntgggaggtgggtggctaggtttgttcagtcgtggagggtctagttgttacaagttggtatgactggaccgccgtaggaacgggtccattcacctactctaccgagacgaccaactacgaagaacactaaagtagttagttacggacctagaaccgacgtaccgtaagtccgtaggtaacggacgtaacgggtagtaacgttaccgtacgttacggaaaccggtaaagggggaacgggggaaaccgacgggtaccgggtaacgttaaccgaaacgttaccgttacgtttacggacggtaccggtcggggtaacccgg

SEQ ID NO: 352979 - DNA, 782 bp, Homo sapiens
  misc_feature: GZ8MTXP02FUMNQ.10.9.A09.1.454.CMB.2.raw
  modified_base (387)..(387): a, c, t, g, unknown or other
  misc_feature (387)..(387): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaacgtggtggagtcgtgggggaggcgtagtccagccgtgggagtcacagagactctcctgtgcagcctgtggttcaccttcagtagcgtacggcagtcgctacgtcggtaccccaaccaaactccgaggacgaagggtattgggagtggggtgacgttaggtttgtttcaagttcgtggagggtctaggttcgtttanaaagttgggttatcgacgttcggaacccggtccggtaagggaaacgggtcccgtaaacgttacccgtaaccctacgttacccgttacccggaaagaaccgtaaaccctaaacccgtacccgaaaacgggtaaaacccaacgttaaaagtttaggtttaaaccgttttacggggaaacccctttaagggaaaacctaaacggtaaccccgtttaaaacggtcccggttaaggaaacgggtaaccggtaacggggtttagtaaaccgtttaacgtaaccgttaagggtaaaccggggaaagggggtaaaccgggggaaccgtaacgggtaacgggtaaccgttaaccgtaaacgttaacgttccgttaggtaccggtacggttaccggggaacccgg

SEQ ID NO: 352980 - DNA, 649 bp, Homo sapiens
  misc_feature: GZ8MTXP02JQ80E.10.9.A09.1.454.CMB.2.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccacctgtctttgtctccgagggaaanagccaccctctcctgcagggccagtcagatggttgcgtccttgtaagctggtaccaacacaaccgtggccaggcctccacggccccctnactctatggtncactccaacgagggccacgtggaccacgtcccagaccgtaggttccaggtcggactaggtgggtagtcgggacagtccttcacttctaccactatcactcacgtcctaggacgcctaggaaatcgtagttcgacgttagttttactacgtataaccgaactacgtcgtaccggaggttcccggcccggtcccgggggtaccttccggtttccccgggtacccgtacggggtaaacccgtaaagggttacggaaacgtaacgtaaaccggaaaaccggtaccgttagggtccgtacgttaaccggacctaaccccgtagttcgttaccggttacctttaccgttacccg

SEQ ID NO: 352981 - DNA, 781 bp, Homo sapiens
  misc_feature: GZ8MTXP02H8FJH.10.9.A09.1.454.CMB.2.raw
  modified_base (270)..(270): a, c, t, g, unknown or other
  misc_feature (270)..(270): n is a, c, g, or t
  modified_base (316)..(316): a, c, t, g, unknown or other
  misc_feature (316)..(316): n is a, c, g, or t
  modified_base (369)..(369): a, c, t, g, unknown or other
  misc_feature (369)..(369): n is a, c, g, or t
tcagcatagtagtgcacgaccggtgctcgatttagcgagacgcgcaggggggagaggagccccagcactagaagtcggcggtgtttccattcggtgatcagcactgaacacagaggactcaccatggagtctgggctgaactgggttttcctcgttgctcttttaagaggtgtccagtgtcaagtgcaacgtgtggagtcgtgggggagcgtagtccagccgtgggaggtcacagagactctccgtgtgcagcctcgtggttccaccttnagtagcacggcatgcacgtcgggtccaccaaactcgaggcgaaggnttgggagtgggtgcgtagttgttcagtctggaggtctagtgttacaagtggtntgctggacgccggtaggaacggtcccagttcaccgtatccgtaccgaagtacgaaccaaacctacccgaaaggtaaacaacgtaaacgttacggtttaaactttacggggtaacccttacggaaaaccgtaccggttaacccgttaaaacgggtcccgttaacggggaaacgggttaaaccggtaacgggggtttaacgttaaaaccgtttaaaaccggttaaccggtttaaacgggggtaaaacccgggtaaaagggggggtaaaccgggggggtaaaaaccccgaagggggtacccgggggttaaaaccgggtttaaaccccggtaaaacgggtttaaacccggtttacccggttttaaccggggtaacccgggtttacccgggggttaccgggggtaaaccccccgggg

SEQ ID NO: 352982 - DNA, 780 bp, Homo sapiens
  misc_feature: GZ8MTXP02JNMPI.10.9.A09.1.454.CMB.2.raw
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaactggtggagtcgtgggggagcgtagtccagccgtgggagtcacgagagacctctcctgtgcagcctcgtggtcaccttcagtacgctacggcagtcgcctacgtcgggtaccccaccaaactcccgaggacgaaggggntttgggaggtggggtgcgttaggtttcgttnagtcgtggacggctagtcgttacagtgtatcgctacggtacgaccggttaggaaacgggtccgtaacttacccgaacctacgtacccgtaccgaacgaacgtaaaccctaaaccgtacccgaaacgggaaaacctaaaccgtaaagttacggtttaaacgttacggtaaccgtaacggtaaacccgtaacgtaacccgttaaacggtaccggttaacgggaaacgggtacggtaaccggggttagttaaacgttaaccgttaaccggttacggggtaaaacggggtaaaacgggggtaaaccgggggtaaaccggtaacggggacccgggggttaaacgtttaaccggtaaaaccggtttaccccggttacggtttaacgggtaaccggtttccgggggtaccgggggttaacccccggg

SEQ ID NO: 352983 - DNA, 563 bp, Homo sapiens
  misc_feature: GZ8MTXP02FGGOB.10.9.A09.1.454.CMB.2.raw
  modified_base (169)..(169): a, c, t, g, unknown or other
  misc_feature (169)..(169): n is a, c, g, or t
  modified_base (343)..(343): a, c, t, g, unknown or other
  misc_feature (343)..(343): n is a, c, g, or t
  modified_base (477)..(477): a, c, t, g, unknown or other
  misc_feature (477)..(477): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagnggtgtccagtgtcaagtgcaactggtggagtcgtgggggagcgtagtccagcctgggagtcacagagactctcctgtgcagcctctgggttcaccttcagtagctacggcatgcacgtgggtccaccaaactccaggcaagggattggagtggggtgctagtttgttcattcgnggaggggcaggtgttacaagttgggtatgctgaccgccgtagaacgggccattcaccatctccagagacaactaccaggaaacactaatgtattcggacctgaaacagcctaagtcctaggacgacgacgggtntactactacgtggtaaacggaaggggacggggaaccaggcgggtaacgttccgaagttacctccgttgaccgtcgcggggtacccg

SEQ ID NO: 352984 - DNA, 601 bp, Homo sapiens
  misc_feature: GZ8MTXP02FSZ2R.10.9.A09.1.454.CMB.2.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (357)..(357): a, c, t, g, unknown or other
  misc_feature (357)..(357): n is a, c, g, or t
  modified_base (379)..(379): a, c, t, g, unknown or other
  misc_feature (379)..(379): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgtggcnctgagctgacaanacaactgccagctcccaggcccctnactctatggtgcatcccaacagggccacgtggcactcccagccaggttcagtcggcaggtgggtatgggacagtctcactcncaccatcatcagcctagggacncctagaagattgttgacttagtttatttaacgtgtacctaacgtagttaccgtaaccgtaggttccggcccggttacccgggggtcccttaccgtttccgggcccgttaggggaaaccctaaagggtagggacgtaacgttaccgaaaaacggtaccgttagggtacggaccgttaacggaccctaaccgtacttccgttacgttaccctttcgttaacccg

SEQ ID NO: 352985 - DNA, 764 bp, Homo sapiens
  misc_feature: GZ8MTXP02IREEJ.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgctcttttaagaggtgtccagtgtcaagtgcaactggtggagtcgtgggggaggcgtagtccagccgtgggaggtcacagagactctcctgtgcagcctcgtgggttcaccttcagtagctacggcatgcacgtcggggtcccaccctaaactccgaggacaagggtattgggaggtgggtggctagtttcgtttcagtcgtggacgggtctaggttgttactaaagttggtagtgtccgtaggacccggtccggttaagggaaacggggtcccgtaacgtttcccgaaaccctcttacccgtacccgaaaggaaacgaaaccccgtaaaccctaaccccggaaacgggaaaaccctaacgttaaaacggtttacgtttaaacgttttacgggaaccgttaaccggaaaccgtaaccggtacccgttaaacgttcccgttaggaaacggggtaccgtaaacggggtttacgttaaacttaaccgttaacggttagggtaaacggggaaaacgggggaacgggggaaacccgaggggtaccgggtaacggtttaaccgaacgtttaccgttaccgtttacggaccggtttcggtacggggtacccggg

SEQ ID NO: 352986 - DNA, 625 bp, Homo sapiens
  misc_feature: GZ8MTXP02IQ32A.10.9.A09.1.454.CMB.2.raw
  modified_base (270)..(270): a, c, t, g, unknown or other
  misc_feature (270)..(270): n is a, c, g, or t
  modified_base (319)..(319): a, c, t, g, unknown or other
  misc_feature (319)..(319): n is a, c, g, or t
tcagcatagtagtggcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgcttcttttaagaggtgtccagtgtcaagtgcaacgtggtggagtcgtgggggagcgtagtccagccgtgggaggtcacagagactctcctgtgcagcctgtggttcaccttnagtagctacggcatgcacgtgggcccacccaaactccgaaggcaagggnttgggagtgggtcgctagtttgttcatcgtggagggtctaggtgttcaagtcggtatggctgggaccgtccggtaggaaaccgggtccgtaattcccgaaactacgtcctaccgagacgactaaccgtacccgaaaggaaccacgtaaagttcggtttaattaccgggacttagaacgtacgtaccgtaacgccgtaggacggtacgtacggtagtactaacgtacgtaggaaacggaaacggggacggggaacaggccggtactaaccgaagttaccttcgttagaccggtcgtacgggtacccg

SEQ ID NO: 352987 - DNA, 731 bp, Homo sapiens
  misc_feature: GZ8MTXP02F5G5D.10.9.A09.1.454.CMB.2.raw
  modified_base (325)..(325): a, c, t, g, unknown or other
  misc_feature (325)..(325): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagccgtgggagtcacagagactctcctgtgcagtcctcgtggttccaccttcagtagctacggcagtcgctacgtgggtccccaccaaactcgaggacgaagggtnttgggaggtgggtgtcgtagtttcgttacagtcgtggacgggctagtcgtttacaagttggtagtcgcgtagtaccggaccggttagggaaaccggggtccctagttcccgaacccgtattacccgaccgaagaacgaaccctaaaccgtaccgaaacggaaacctaacgtaaagttacgttaacgtttacgggaacctagtaaaccgacgtaacccgttaacggtccgtaacggaacggtaaccgtacggggttattaaccgtaacgttacggtaaagggtaaccggggaaaagggggtaccgggggaaaccgtacggggtaccgggttaaacgttaaccgtaaaacgggttacccttaccggtttacgggaacccggtttcggggtaccgggggttaaccccgg

SEQ ID NO: 352988 - DNA, 653 bp, Homo sapiens
  misc_feature: GZ8MTXP02GBDH7.10.9.A09.1.454.CMB.2.raw
  modified_base (328)..(328): a, c, t, g, unknown or other
  misc_feature (328)..(328): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaacgtgggtggagtcgtggggggagcgtagtccagccgtgggagtcacagagactctcctgtgcagtcctcgtggttcaccttcagtagctacggcatgacacgtcgggtccccaccaaactccgaggacgaaggggtnttgggaggttggggtgcttaggtttgttcattcgtggagggtctaggtgttacaagttgtgtgcgtgacgccgtaggacggcctatcgacatcctacagacaccgaactaccgaaggaaaccagtaaagtcgttaacgtttcgggtaacctaggtaaccacggtaacccttaaaggtccctaggggaacggtaccggtaggggtacgttaaacgtacgtaacggtacgggtaaaccgggaaaagggggacgggggtaaccgagggtcgggtaacgttaacgtaacggttacgttcgttacggacggttcggtaccgggtaaccgg

SEQ ID NO: 352989 - DNA, 744 bp, Homo sapiens
  misc_feature: GZ8MTXP02FE91S.10.9.A09.1.454.CMB.2.raw
  modified_base (171)..(171): a, c, t, g, unknown or other
  misc_feature (171)..(171): n is a, c, g, or t
  modified_base (333)..(333): a, c, t, g, unknown or other
  misc_feature (333)..(333): n is a, c, g, or t
tcagcatagtagtgcacgaccggtgctcgatttagcgagacgcgcgagggggggagaggagcccagcactagaagtcggcggtgtttccattcggtgatcagcactgaacacagaggactcaccatggagtctgggctgaacttgggttttcctcgttgcttcttttaagnggtgtccagtgtcaagtgcaactggtggagtcgtgggggagcgtagtccagcctgggagtcacgagagactctcctgtgcagcctcgtggttcaccttcagtagctacggcagtgccacgtgggtcccacaaactccgaggcgaggggattgggagtggggngctagtttgttcagttcgtaggagggtcaaggttgttacgaaagttggggtatcggcgttaggaccggccgttaggaaaccggggtcccgtaactttaccaaccctagtcctaccgaaggtaacaccgtaaactacccgaaggaaacctaacgaaagttcgtaacgtttacgggaacccttaggaaaccgtacggacccttaaacggtacccgttaggtaacgggaaccgtaccgggggtttagtaaaacgtttaacgtaaacggtacggttaaaacccgggggaaaagggggtaaccggggggaaaacccagggggtaccggggttaaacggttaacccggtaaaacgggtttacccttaaccgggtttcggtaaaccgggttccggggttaccgggggtaaaccccggg

SEQ ID NO: 352990 - DNA, 704 bp, Homo sapiens
  misc_feature: GZ8MTXP02FSL0E.10.9.A09.1.454.CMB.2.raw
  modified_base (330)..(330): a, c, t, g, unknown or other
  misc_feature (330)..(330): n is a, c, g, or t
  modified_base (361)..(361): a, c, t, g, unknown or other
  misc_feature (361)..(361): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccagccgtgggagtcacagagactctcctgtcgcacgtcctcgtgggttcctaccgttcagtacgcgtacggcatgcacgtcggtacccaccaaactccgaggacgaagggtnttgggagtgggtgcgtagtttgtacagtcgnggaggtctagttgttacgaagttgtatgcgttaggaccgtcggtaggaacgggtcccgtataccaccgtatacctaccgaagacgaaccaactaccgaaacggaaaccagtaaagttcgtttaaagttacggaacctacggaaaccgtacgtaacccgttaaacggtccgtaacgggaacgggtacccggtaaaggggttacgtaaacgttacgtacccggttaaagggtaaaccggggaaagggggtaacggggaaccgtacgggggtaccggttaaacgtaaccgtaaacggttaccgttaccggttacggtaccggttccggtaacggggtaaccccggg

SEQ ID NO: 352991 - DNA, 720 bp, Homo sapiens
  misc_feature: GZ8MTXP02JI7NI.10.9.A09.1.454.CMB.2.raw
  modified_base (387)..(387): a, c, t, g, unknown or other
  misc_feature (387)..(387): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaacgtggtggagtcgtgggggaggcgtagtccaggcctggggaggtcacagagactctcctgtgcagcctcgtcgggttccaccttcagtcgctacggcatgcacgtcgggtcccaccaaactccgaggacgaagggattgggaggtgggtggcgtaggtttgtttacagttcgtggagggctagtgttacaagttggtntgcgtacggaccgtccggtaggaaacgggtcccgtacttcccgaacctacttccgaccgaagaacgaaccctaaacgtaacccgaacgggtaaaaccaacgtaaacgttagttacgtttaccgggaaccttacggtaaaacctacggtaacccgttaaacggttccgtaagggaacggtaaccggtaccggggttagtaaccgtaacgttaacgtaggggtaaacgggaaacgggggaaacgggggtaacccgtaacggggacggggtaacggttaaccgtaaacggttacccgttacggttacggtaacggttccggtacgggggtacccgg

SEQ ID NO: 352992 - DNA, 735 bp, Homo sapiens
  misc_feature: GZ8MTXP02H56CM.10.9.A09.1.454.CMB.2.raw
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgacaacgtggtggagtcgtgggggagcgtagtccagccgtgggagtcacagagactctcctgtncagccctgtggtcacttnagtanctacgnatcgcacgtcggtcccacctaaacgtccgaggaccgtaaaaggggtactttaggggaacggttggggtcggtacgttaggttttgtttaccagttccgtagggacgggtctaggttcgttacaagttcgggtatcggcgtacggaccgtccggtagggaacgggtcccacgttccactacttcccacgaaacgacgtaaccctaaacgtcccgaaaacggacctaaacgtaaagtttcgttaaacgttttacgaaaccccgttaggaaaccgtaaccgtacccgttaaaggtcccgtaggaaaccggtaccggttagggttacgttaaacgtaacgttacggtaagggtaaaccggaaaagggggaaccggggtaaaccgacggggtaacgggttacgtttaaaccgaaacgtttaccgttaccgtttaggaaccggttcggttaacgggcccgg

SEQ ID NO: 352993 - DNA, 622 bp, Homo sapiens
  misc_feature: GZ8MTXP02HXSC8.10.9.A09.1.454.CMB.2.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (276)..(278): a, c, t, g, unknown or other
  misc_feature (276)..(278): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctcagcccacctgtctttgctccgagggaaanagcccaccctctcctgcagggccagtcagaatgtgcncttgagctgacacacaacngcngctccagccnatnatgnnncanggcagngncnccagccgagttcagtcgactaggtggtatgggacagtccttcgacttccncaacctnctactcacgcctaggacgtccgtagtaaaggtactggttagaccgtttagtttaacttaccgttagtaaccaaacgttaacgttaccgggtacccggtaggtcgggtacccccggtcccgggggtacccttaaccgggtttccccgggacccggttacggggtaaaaccgtaaacgggttacgggaaaccgtaaacttaacccggaaaacgtaccggttaggtaccggtacgtcgaacctaccgtacgttacttacggttaccttacgtacccg

SEQ ID NO: 352994 - DNA, 697 bp, Homo sapiens
  misc_feature: GZ8MTXP02F7B2G.10.9.A09.1.454.CMB.2.raw
  modified_base (300)..(300): a, c, t, g, unknown or other
  misc_feature (300)..(300): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactgggtggagtcgtgggggaggcgtagtccagcctggggagtcacagagactctctgtgcacgcctcgtggttcaccttcgagtagctacggcatgcacgtgggacccncaaaccgtccgaggcgaagggtgttgggaggtggggtggcgttagtttgttcattcgtggaggctagtcgttacaaagtgggtactgtacgttacggaccggtcccggtagggaaaccgggtccgtaacttccgaccctacgtacctaccgaagtacgaacctaacgtccgaaaggtaaccacgttaaagtcgtttaacgtttacgggaccctagtaaccgtacgtaaccctaaggttcctacgggtaaggaaccggtaacgggttacgttacgtaaccgttaacgtacggttaacggggaaaacgggggacgggggtaacacgggggtacggtacgttaaccgtaaacgttaccgttacccggtttaggacccgttcgggtacgggggtaccccgg

SEQ ID NO: 352995 - DNA, 633 bp, Homo sapiens
  misc_feature: GZ8MTXP02I9X6D.10.9.A09.1.454.CMB.2.raw
  modified_base (273)..(273): a, c, t, g, unknown or other
  misc_feature (273)..(273): n is a, c, g, or t
  modified_base (327)..(327): a, c, t, g, unknown or other
  misc_feature (327)..(327): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (518)..(518): a, c, t, g, unknown or other
  misc_feature (518)..(518): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaactggtggagtcgtgggggagcgtagtccaggcctggggaggtcacgagacgactctcctgtgcagcctgtggttccaccttnagtagctacggcatcgacacgtcgggtccccaccaaactccgaggacgaagggngttggaggtgggtgctagttgttcagtcgtgagggntagtgttagaagttggtntcgctagaccgtccggtaggaacgggcgtacttccacctagtacctaccagtacaccaacgtaccgaacgaacataaagtgttacgttacgaccgtagaccacgtaccgtaagtccgtaggacggacgtaacgggtntaacgtaactacgttaaggtaacgggaaacggggaacgggggtaacccagggtaccggtaacgttaaccgaacgttacgttaccgttacggtacgtaccggtacgggtaccccgg

SEQ ID NO: 352996 - DNA, 608 bp, Homo sapiens
  misc_feature: GZ8MTXP02H6PZC.10.9.A09.1.454.CMB.2.raw
  modified_base (263)..(263): a, c, t, g, unknown or other
  misc_feature (263)..(263): n is a, c, g, or t
  modified_base (354)..(354): a, c, t, g, unknown or other
  misc_feature (354)..(354): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagccgtgggagtcacagagactctctgtgcagcctgtggttcacttnagtagctacgcatgcacgtcgggtccaccaaactccaggacaagggtattgggagttggggtgctagtttgttcagtctggaggtcagttntacaagtggtatgacgtggaccgtccggtaggaaacgggtcccagttccgacctatcctccaagacaccaaactccgaaggtaacaacgtaaattgttattacggtacctagaacacgtacccgtaagtcctaggaacggtacgtacgggtagtaactacgtacgtaggaacgggtaaaggggaacgggggacacggtacgggtacgttaaccgaagttaccgttaccgtttggaccgttcggcgggtacccgg

SEQ ID NO: 352997 - DNA, 698 bp, Homo sapiens
  misc_feature: GZ8MTXP02FQFKU.10.9.A09.1.454.CMB.2.raw
  modified_base (272)..(272): a, c, t, g, unknown or other
  misc_feature (272)..(272): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagccgtgggagtcacagagactctcctgtgcagcctcgtgggttcaccttcagtanctacggcatcgcacgtgggcccaccaaactccgaggcgaaggntgggagtgggngctagttgttcattcgtggacgggtcaaggttcgttacaaagttgggtatggccgttaggacccggtccgggtaggaaacgggggtccctaagtttccaacccgtactaccgtacccgaaggacgaacccaacggttaccccgaaagggaaacctaacctaaagttacgtaacgtttacgggacccgtagaaacctaacggtaccccttaaagtccgttaggacggggaacctacggggtataaacgtaaccgttaacgtacggtaaacggggaaacgggggaaacgggggaaccgaaggggaccgggtaacggttaacccgaaacgttacgtaccgtttacggaccggttacggtacgggggtaaccccgg

SEQ ID NO: 352998 - DNA, 805 bp, Homo sapiens
  misc_feature: GZ8MTXP02I32I0.10.9.A09.1.454.CMB.2.raw
  modified_base (170)..(170): a, c, t, g, unknown or other
  misc_feature (170)..(170): n is a, c, g, or t
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagnggtgtccagtgtcaagtgacaacgtggtggagtcggtgggggaggcgtagtccagccgtgggagtcacgagagtactctcctgtgcacgtcctcgtggttcctaccttcagtcgctacggcagtcgcacgtcggtcccacaaactcgaggcaaagggtgttgggaggttggggtgcgttagtttcgtttacagttcgagggacgggtctaggttacgttacgtaaagttcgggttagtcggtaccgttacgggtacccggtccgggttaaggggaaaccgggggtccctaaacttaacccgacccttaaccgtaccgtaccgaaagggtaaaaccgtacccctaaaccgtacccggtaaaacggaaaacctaacgtaaaacggtttaccggtttaaacgtttaccgggtaaacccgttaacgaaaccgtaaccgtaaccccgtttaaacgtaccggtacggggaaacgggtaccggttaaacggggttacttaaacgtaaaccgttaccgggttaaaaggggtaaccgggggtaaaacgggggaccgggggtaaaacgtacgggggtaccggtaacgtaaccgtaacgttaccgtttaccggttacggtaccgtccggggtacggggtaacccgg

SEQ ID NO: 352999 - DNA, 725 bp, Homo sapiens
  misc_feature: GZ8MTXP02IFUQR.10.9.A09.1.454.CMB.2.raw
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggaggcgtagtccagcctgggaggtcacagagactctcctgtgcagcctctgggttcaccttcagtacgctacggcatgcacgtcggccaccaaactccgaggcaagggnttggagtgggtgctagttnttcagtcgtggagggcaggttgttacaagttcggtatcgacgttgggaccgtcccgggtagggaaacggggtccgtaacgttccgaccctacgtccgtaccgaacgaacgaaccaaaccgttacccgaaagggaaaccaaccgtaaagttacggttaaacgttttcggtaacccttagaaaccgtacgtacccgttaaacggtcccgttacggaacggggtaaccgtaacggggttaacgttaacgttaaccgttaaccgttacgggtaaacgggtaaacgggggaaacggggggtaaacccgtaacggggtaccggggttaacggttaacccgtaaacggttacccgttaccggtttacggtaccggtttaccggtacgggggtaacccgg

SEQ ID NO: 353000 - DNA, 749 bp, Homo sapiens
  misc_feature: GZ8MTXP02H86IS.10.9.A09.1.454.CMB.2.raw
  modified_base (167)..(167): a, c, t, g, unknown or other
  misc_feature (167)..(167): n is a, c, g, or t
  modified_base (266)..(266): a, c, t, g, unknown or other
  misc_feature (266)..(266): n is a, c, g, or t
  modified_base (455)..(455): a, c, t, g, unknown or other
  misc_feature (455)..(455): n is a, c, g, or t
tcagcatagtagtgcacgaccggtgctcgatttagcgagacgcgcaggggggagaggagcccagcactagaagtcggcggtgtttccattcggtgatcagcactgaacacagaggactcaccatggagtctgggctgaactgggttttcctcgttgctcttttaagnggtgtccagtgtcaagtgcaacgtggtggagtcgtgggggagcgtagtccagcctgggagtcacagagactctcctgtgcagcctcgtggttcaccttnagtacgctacggctatcgcacgtgggtacccaccaaacgtccgaggacgaaggggtattaggggaggtggggtaggactaggtttcgtttcagtccgtaggacgggtctacggttgttacaagttggttacgtggacgttacggaccgtcccggttaggaacgggggtccccgtaaattccaacccgtntaccgtacccgaagacgaaacctaccgacccgaaacgggaaacctaagtaaacgtttaggttaaacggtttacggaaccgttacgggaaacctacgtaacccgttaaacggtcccgtaagggaacggtacggtaacccggggttagttaaccgttaacgttaacggtttacgggtaaaccgggaaaacgggggaaccgggggtaaaccgacgggggtaccggtaaccgttaaccgtaaacggttacccgtttaccggtttacggaaccgggttccggttacggggtaaccccgg

SEQ ID NO: 353001 - DNA, 700 bp, Homo sapiens
  misc_feature: GZ8MTXP02GCBJI.10.9.A09.1.454.CMB.2.raw
tcagcatagtagtgcacgaccggtgctcgatttagcgagacgcgcagggggggagaggagcccagcactagaagtcggcggtgtttccattcggtgatcagcactgaacacagaggactcaccatggagtctgggctgaacttgggttttcctcgttgcttcttttaagaggtgtccagtgtcaagtgcaacgtggtggagtcgtgggggagcgtagtccagccgtgggagtcacgagagactctcctgtgcagcctgtggttcaccttcagtagctacggcagtcgctacgtcgggtcccaccaaactccgaggacgaagggtagttgggagtgggtggctagtttgttcagtcgtggaggctaggtgttacaagttggtagtgctagaccgtccgtaggaacgggtcccgtatccgaacctactactccgaagtacgaacctaacctaccgaacggaaacaacgtaaagttagttaacgtttacggaccgttaagaaccgtaagtacccgttaacgtacccgtaggtaaacggaccgtaacgggtacgttaacgttaaccgtacggttaacggtaaacggggtaaacgggggtaaacgggggaaaccgaacgggggtaaccggggtaacggtttaaccgtaaaacgtttccggttaacccgtttaggtaaccggttccgggtagggggtaacccccgg

SEQ ID NO: 353002 - DNA, 518 bp, Homo sapiens
  misc_feature: GZ8MTXP01CZ1Q5.9.39.D06.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
  modified_base (360)..(360): a, c, t, g, unknown or other
  misc_feature (360)..(360): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtggttancctggcaccagcaaaacctggccagcctcccaggctcctcatctatgatgcatccaccaggacccactggtcgtcccagccaggttccaggtgggagtgggtctggggacngagttcactctccacatcagcagtctgcagtcggaagtattttgctagtttactattgtcagnagtatagtaacggcgctacncgttcgggcggaggaccgaaagggtggagtattacgaaacgacttagttgggctgcaaccatcttgtcttgtaac

SEQ ID NO: 353003 - DNA, 506 bp, Homo sapiens
  misc_feature: GZ8MTXP01A33BT.9.39.D06.1.454.CMB.2.raw
  modified_base (203)..(203): a, c, t, g, unknown or other
  misc_feature (203)..(203): n is a, c, g, or t
  modified_base (355)..(355): a, c, t, g, unknown or other
  misc_feature (355)..(355): n is a, c, g, or t
  modified_base (503)..(503): a, c, t, g, unknown or other
  misc_feature (503)..(503): n is a, c, g, or t
tcagtgatacgtctcacgaccggtgctcgatttagtgacatctcgcagttctttggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaactggccagcctccaggctcctcatctatgatgcatccaccaggaccactggtgtcccagccaggttccaggtgggagtgggtctgggacngagttcactctcacatcagcagtctgcagtcggaatatttgctagtttactattgtcagcagtatagtaacgggcgctcactttcgggcggtagggaccaagggtggagattcgaaacgaacttgttggctgcaaccatcttgtcttnaac

SEQ ID NO: 353004 - DNA, 520 bp, Homo sapiens
  misc_feature: GZ8MTXP01C80N4.9.39.D06.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (361)..(361): a, c, t, g, unknown or other
  misc_feature (361)..(361): n is a, c, g, or t
  modified_base (398)..(398): a, c, t, g, unknown or other
  misc_feature (398)..(398): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccagggggaaanagccaccctntcctgcagggccagtcagagtgttagtagtaggttagccctggcaccagcaaaaacctggccagcctcccaggctcctcatctatgatgcatccacaggaccactggtgtcccagccaggttccaggtgggagtgggtctgggacngagtcactctcacatcagcagtctgcagtcggaagtntttgctagttactattgtcagtctaagtactagtaaccgggccgtctcgactttcgggacggtacggggacctaagggtggagattcgaaacgacttgttggctgcaacatcttgtcttctc

SEQ ID NO: 353005 - DNA, 573 bp, Homo sapiens
  misc_feature: GZ8MTXP01EVMQC.9.39.D06.1.454.CMB.2.raw
  modified_base (205)..(205): a, c, t, g, unknown or other
  misc_feature (205)..(205): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (354)..(354): a, c, t, g, unknown or other
  misc_feature (354)..(354): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangcccaccctctcctgcagggccagtcagagtgttagtagtaggtagcctgcacagacaaaactgcagcctccagctcncatcatgatgcatccaccaggacccagtggtntcccagcccaggttccaggtgggaggtggtctagggacngagttcactcgtcaccatcagcagtctgcagtacggaagttatttgacttagtttactattgtacgagtctaagtagtaggtaacggccgtactaccgtacgtttcgggacgggtaacgggaccgaaagggttgggaagtacgttaaccgtaaaacggtacgttgggttcgggttctaaggacctaaccgacttccgttcggttccgttcgttaacccg

SEQ ID NO: 353006 - DNA, 516 bp, Homo sapiens
  misc_feature: GZ8MTXP01DJA0K.9.39.D06.1.454.CMB.2.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (415)..(415): a, c, t, g, unknown or other
  misc_feature (415)..(415): n is a, c, g, or t
tcagtgatacgtctcacgaccggtgctcgatttagtgacatctcgcagttctttggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctntcctgcagggccagtcagagtgttagtagtaggttancctggcaccagcaaaaacctggccagcctccaggctcctcatctatgatgcatccaccaggacccactggtgtcccagccaggttccagtgggagtgggtctgggacngagttcactctcaccatcagcagtcngcagtagatnttgatagttatattgtcgagtntagtagtagtacggcgtctcgtacgttcggacggacggacgaaggtgagtacgttacgaaacgtacgttggttcggctgacaactatcttcgttcttcgtc

SEQ ID NO: 353007 - DNA, 594 bp, Homo sapiens
  misc_feature: GZ8MTXP01DPNYA.9.39.D06.1.454.CMB.2.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (361)..(361): a, c, t, g, unknown or other
  misc_feature (361)..(361): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccactggagaaatagtgatgacgcagtctccagcccacctggctgtgtctccgaggggaaangcccaccctntcctgcagggccagtcagagtgttagtagtaggttagcctggcaccagacaaaactggccagcctccaggctcctcatctatgatgcatccaccaggaccactggtcgtcccagccaggttccaggtgggagtgggtctgggacnggagttcactctcacatcagcagtctgcaggtacgaagtatttgacttagtttactattgtcgagtctaagttaataggtaaccgggccgtacttcgtacgtttcggggacgggtacggggtaacccgaagggtgggaagtaacgttaccgaaaaacggtaaccgttagggttcggttccgttaagggaccctaaccctagttccgttacggtttccgtttaacgttaacccg

SEQ ID NO: 353008 - DNA, 636 bp, Homo sapiens
  misc_feature: GZ8MTXP01EFBFM.9.39.D06.1.454.CMB.2.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (401)..(401): a, c, t, g, unknown or other
  misc_feature (401)..(401): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctcgaggggaaangccacctntcctgcagggccagtcagagtgttagtagtaggttagcctggcaccagacaaaaacctggccagcctccaggctcctcatctatgatgcatccacaggaccacgtggtcgtcccagcctaggttccaggtgggagtgggtcgtagggacngngttcactctacacatcagcagtctgcagtacggaattntttgacttagtttactagttgtcgtaaggtctaaggttaagtaacgggtaaccggggtcccgtacgtttaccgttaacggttttcccgggggaacggggtaacggggtaaccccggtaaaaggggttcgggaaacggttaacgttaaaccggaaaaacggttaaccgttgggttcggggttacttcgggaccgaaccgttaacttccgttacgttaaccgttttccgttaacccg

SEQ ID NO: 353009 - DNA, 513 bp, Homo sapiens
  misc_feature: GZ8MTXP01CXODV.9.39.D06.1.454.CMB.2.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (394)..(394): a, c, t, g, unknown or other
  misc_feature (394)..(394): n is a, c, g, or t
  modified_base (485)..(485): a, c, t, g, unknown or other
  misc_feature (485)..(485): n is a, c, g, or t
  modified_base (498)..(498): a, c, t, g, unknown or other
  misc_feature (498)..(498): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccacctggctgtggtctccgaggggaaangccaccctntcctgcagggccagtcagagtgttagtagtaggttancctggcaccagcaaaacctggccagcctccaggctccncatctatgatgcatccacaggactatggtgtccagccaggttccaggtgggagtgggtctggggacngattcactctcacatcancagtctgcagtcggaagtntttgctagttactattgtcagctagtatagtaacggcgctcacgttcggcggtacggacctaagggtggagtagttcgaaaacgcttaggnggctggcaacgtntcttcgttcttcgtc

SEQ ID NO: 353010 - DNA, 595 bp, Homo sapiens
  misc_feature: GZ8MTXP01EK2SM.9.39.D06.1.454.CMB.2.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccgagggggaaangcccaccctctcctgcagggccagtcagngtgttagtagtaggttancctggcaccagcaaaacnggccagcctccaggctcctnatctatgatgcatccacaggaccatgtgtcccagccaggttccaggtgggagtgggtctagggacngtacgttcactctacaccatcagcagtctgcagtacggaatatttgactagtttactagttgtcgagtctaagttagtaaggtaaaccggggtccacgttaccgtacgtttcggggacgggtaacgggacccgtaaaggggtgaaggtaacttaacgaaaacggtaacgttgggttcgggacccttaagggaccaaacccgtttacgttccgttacgttcccgtttaacgtaacccg

SEQ ID NO: 353011 - DNA, 567 bp, Homo sapiens
  misc_feature: GZ8MTXP01BY1D9.9.39.D06.1.454.CMB.2.raw
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaaangccacctntcctgcagggccagtcagagtgttagtagtaggttancctggcaccagacaaaacctggccagcctccaggctcctcatctatgatgcatccacaggaccactggtctcccagccaggttccaggtgggagtgggtcgtaggggacnggacttcactctcaccaatcagcagtcngcagtacgtatattgacttagtttactagttgtacgtagtacgtaagttaagtaacggtaaccgggccgtacgtaccgtacggttccgggacgggtaacgggaaccgtaagggtggaaagtaacttaacgtaaaacgtacgttggttcgcgtcgaccaactgtcttcgttcttcgtaacg

SEQ ID NO: 353012 - DNA, 596 bp, Homo sapiens
  misc_feature: GZ8MTXP01D6QLC.9.39.D06.1.454.CMB.2.raw
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccacctggctgtgtctccgagggaaangccacctctcctgcagggccagtcagagtgttagtagtaggttancctgcacagcaaaactggccagcctccaggctctcatctatgatgcataccaccaggacccactggtcgtcccagccnggtcccaggtgggagtggtctgggacngtagtcactctcaccatcagcagtctgcagtacggaagttatttgactagtttactaagtttcgtacgtaacggtctaaaggttaagttaacggggtaaaccggtcccgtacgttaccggttaccggttttacgggggaccgggttacggggaacccgtaaaggggttggaagtacgttacgaaaaccgtaacgttggttcgggacttggccaaccgttatcgttgttcctttcgttaaccc

SEQ ID NO: 353013 - DNA, 567 bp, Homo sapiens
  misc_feature: GZ8MTXP01CH4E1.9.39.D06.1.454.CMB.2.raw
  modified_base (152)..(152): a, c, t, g, unknown or other
  misc_feature (152)..(152): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (405)..(405): a, c, t, g, unknown or other
  misc_feature (405)..(405): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactgganaaatagtgatgacgcagtctccagcccaccctggctgtgtctccgaggggaaangcccaccctntcctgcagggccagtcagagtgttagtagtaggttagcctggcacagacaaaactgccagcctccagctccncatctangatgcatccacaggaccactggtcgtcccagcctaggttcccaggtggggagtgggtcgtagggacngtagtcacttcncaccatcagcagtctgctaggtcggaagttntttgctaagtttactattgtacagtctaagtacgtacgtaacggggccactacgtacgtttcgggacggaagggtaccaaagggtgggaaatacgttaacgaaaacggtctttaagggcggacttcggacctaacctagtcgttcgttaacttcgtaacccg

SEQ ID NO: 353014 - DNA, 605 bp, Homo sapiens
  misc_feature: GZ8MTXP01B2UQX.9.39.D06.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (362)..(362): a, c, t, g, unknown or other
  misc_feature (362)..(362): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaaangccaccctntcctgcagggccagtcagagtgttagtagtaggttagcctggcaccagcaaaaacctggccagcctcccaggctcctcatctatgatgcatccaccaggaccactggtcgtcccagccaggttccaggtgggagtgggtcgtagggacnggagttcgactctcaccgtatcagctagtctgcagtacggagttatttggactagtttactatttcgtacgtagtctaggttactaggtaaccgggccgtctaccgtaacgttttccggggacgggtaacggggacccgtaaagggggtggaaaggacgttacgaaaaccgggtaacgttgggttcggaccgttcgggaccctaacccgtagttccgttcggttccgtttaacgttaaccccg

SEQ ID NO: 353015 - DNA, 538 bp, Homo sapiens
  misc_feature: GZ8MTXP01DIERQ.9.39.D06.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (360)..(360): a, c, t, g, unknown or other
  misc_feature (360)..(360): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatgtgatgacgcagtctccagccaccctggctgtgtctccgaggggaaangccaccctntcctgcagggccagtcagagtgttagtagtaggttagcctggcaccagcaaaactggcagcctccaggctcctcatctatgatgcatccaccaggacccaactggtcgtcccagccaggttccaggtggggagtggtcctgggtacngagttcacgtctcaccatccagcagtctgcagtacggaagtattttgcttagttactattgtcaggctagtataggtaacgggctctactaccgtttcgggcggagggaaccaagggtggagtattacgaaaggtacgttagttcgggacttgacaacctatcgttcgtcttctaacg

SEQ ID NO: 353016 - DNA, 586 bp, Homo sapiens
  misc_feature: GZ8MTXP01CGQMK.9.39.D06.1.454.CMB.2.raw
  modified_base (209)..(209): a, c, t, g, unknown or other
  misc_feature (209)..(209): n is a, c, g, or t
  modified_base (255)..(255): a, c, t, g, unknown or other
  misc_feature (255)..(255): n is a, c, g, or t
  modified_base (546)..(546): a, c, t, g, unknown or other
  misc_feature (546)..(546): n is a, c, g, or t
  modified_base (557)..(557): a, c, t, g, unknown or other
  misc_feature (557)..(557): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaaatagtgatgacgcagtctccagcccaccctggctgtgtctccgaagggggaaancgcccaccctctcctgcagggccagtcagatgttagtagtaggtancctggcacagacaaaaacctggccacgccctcccaggcctcctcattctatgatgcactccacagacctagtggtcgtccagcctaggttcccgaggtggggaggtggggtcgtaggggacaaggtacgttaccacttccgtcacctatcgagcgtagtctggacgtaaggtacgggtaaacgttagttttcgactttaagtttacttagtttgtaaccgtagtacgtaagttacgtaacggtaaccggacctactaccgtacgttcgggacggaggaccgaaggtgaganacgaaacgtcngttgcngcaacntcttatcgttctaaccg

SEQ ID NO: 353017 - DNA, 557 bp, Homo sapiens
  misc_feature: GZ8MTXP02IZTPZ.9.39.D06.1.454.CMB.2.raw
  modified_base (204)..(204): a, c, t, g, unknown or other
  misc_feature (204)..(204): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaancgccaccctctcctgcagggccagtcagagttgttagtagtaggttagcctggcacagacaaaactggcagcctcccaggctcctcatctatgatgcatccaccaggacccacgtggtcgtcccagcctaggttccaggtgggaggtgggtctggggacngngttcacgtctcacatcagcagtctgacagtcggaagtattttgacttagtttactattgtcagtctagttagtaaggtaaccgggccgtcttacgtacgtttcggggacgggacgggtaaccgaagggtggaagacgtaacgaaacgtaacgtggtacggctgacccaacgatcgtacgttcttctaaccg

SEQ ID NO: 353018 - DNA, 531 bp, Homo sapiens
  misc_feature: GZ8MTXP02H6HTJ.9.39.D06.1.454.CMB.2.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (268)..(268): a, c, t, g, unknown or other
  misc_feature (268)..(268): n is a, c, g, or t
  modified_base (355)..(355): a, c, t, g, unknown or other
  misc_feature (355)..(355): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtntctccaggggaaanagccaccctctcctgcagggccagtcagagtgttagagtaggttagcctggcacagcaaaacnggccagcctccaggctcctcatctatgatgcatccaccaggaccactggtatcccagccaggttccagtgggagtgggtctgggacngagttcactctcacatcagcagtctgcagtcggaagtactttgctagtttactatttgtcagtcagtataggtaacggcgtactctacgtttcgggacgggtacgggaaccgtaagggtagggagacgtacgaaaacggaacgtggtcggactggacaaccatcttcgtcttctac

SEQ ID NO: 353019 - DNA, 579 bp, Homo sapiens
  misc_feature: GZ8MTXP02GEN3C.9.39.D06.1.454.CMB.2.raw
  modified_base (205)..(205): a, c, t, g, unknown or other
  misc_feature (205)..(205): n is a, c, g, or t
  modified_base (362)..(362): a, c, t, g, unknown or other
  misc_feature (362)..(362): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangccaccctctcctgcagggccagtcagagtgttagtagtaggttagcctggcaccagacaaaacctggccagcctccaggctcctcatctatgatgcatccaccaggaccactggtcgtcccagccaggttccaggtgggagtggggtctggggacnggtattcactctcacatcagcagtctgacagtacggagtatttgacttagtttactattcgtctaggtcaagttaagttaacggtaaaccgggccgtacttaccgtaacggtttccgggacgggtacgggaaccgtaaggggttggagtacgtaacgaaacgtaacgtggtacggactaacggcctaaccgtacttcgtcgttaccttacttaaccg

SEQ ID NO: 353020 - DNA, 508 bp, Homo sapiens
  misc_feature: GZ8MTXP02H0UTV.9.39.D06.1.454.CMB.2.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaaanagccaccctntcctgcagggccagtcagagtgttagagtaggttancctggcacagcaaaacngcagcnccagcnctnatcatgatgcatccacaggacactgtgccagccagtccagtgggagtgggtctgggacngagttcacttcncaccatcaagcagtcngnagagagtattgtntagttatattgtanaganagtagtagtacggacgactactacgttacggtacggacggaaacgaacggaggagaacaacgaaacgaacgtacgtagacgtcgacacactactcgtacttactac

SEQ ID NO: 353021 - DNA, 515 bp, Homo sapiens
  misc_feature: GZ8MTXP02JZONF.9.39.D06.1.454.CMB.2.raw
  modified_base (205)..(205): a, c, t, g, unknown or other
  misc_feature (205)..(205): n is a, c, g, or t
  modified_base (365)..(365): a, c, t, g, unknown or other
  misc_feature (365)..(365): n is a, c, g, or t
tcagtgatacgtctcacgaccggtgctcgatttagtgacatctcgcagttctttgggggaggaactgctcagttaggacccagacggaaccatggaagcccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagacaaaacctggccagcctcccaggctcctcatctatgatgcatcccaccacggaccactggtgtccccagcccaggttcccagtgggagtgggtctggggacngagttcactctcaccatcagcagtctgcagtcggaagtatttgctagtttactattgtcagcagtatagtacggcgtctcacgtttcggacggtaggaaccaagggtggagactacgaaacgactggtggctgacacatcctgtcttcac

SEQ ID NO: 353022 - DNA, 545 bp, Homo sapiens
  misc_feature: GZ8MTXP02HXYAY.9.39.D06.1.454.CMB.2.raw
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (399)..(399): a, c, t, g, unknown or other
  misc_feature (399)..(399): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccaggggaaanagccaccctctcctgcagggccagtcagagtgtagagtaggtanctggcacagcaaaacngcagcnccagctctcatctatgatgcatccacagacactgntcccanccagtccagtgggatgggtctggggacngagttcactctcaccatcagcagtntgngagtagagtattagtactagttacttattgtanagtatagtaagtaaggtaacggaccgacgtacgtacgttacggtacgggaaacggaaacggtaaacggtaggaaggaacgtaaacgtaaaacgtaaacgtacggtacggtacgtaacgacaacctactacgtcgttacttactacg

SEQ ID NO: 353023 - DNA, 520 bp, Homo sapiens
  misc_feature: GZ8MTXP02H9CM1.9.39.D06.1.454.CMB.2.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (360)..(360): a, c, t, g, unknown or other
  misc_feature (360)..(360): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccagggggaaangccaccctntcctgcagggccagtcagagtgttagagtaggttagcctggcacagacaaaacctggccagcctcccaggcctcctcatctatgatgcatccacaggaccactggtcgtcccagccaggttccagtgggagtgggtctggggacnggagttcacgtctcaccatcagcagtctgcagtcggaagtatttgactagtttactattgtcagtcagtataggtaacgggcactcgtacgtttcggacggtaggaaccgaaggtggagacgtacgaaacgacgtgtcgctgcacactctcgtcttctac

SEQ ID NO: 353024 - DNA, 532 bp, Homo sapiens
  misc_feature: GZ8MTXP02GMZM9.9.39.D06.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangcccaccctntcctgcagggccagtcagagtgttagtagtaggttagcctggcaccagacaaaacctggccagcctcccaggctcctcatctatgatgcatccaccaggacccacgtggtcgtcccagccaggtcccagtgggagtgggtctgggacngagtcacgtcncacatcagcagtctgcagtacggaagtatttgctagtttactattgtcagtcagttaataggaaacgggccgcttcgtaacgtttcgggacgggtagggaaccaagggtcggaaggactacgaaacgactcggtgctgcaactatcctagtctctacg

SEQ ID NO: 353025 - DNA, 829 bp, Homo sapiens
  misc_feature: GZ8MTXP02GM5MA.9.39.D06.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (471)..(471): a, c, t, g, unknown or other
  misc_feature (471)..(471): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaancgccaccctntcctgcagggccagtcagtagtgttagtagtaggtnacgtcgngaccacganaaaaccaaacggtcgacaccgtccccacggcgcctccatcttacgtgtagtgtccactacctaccccgaacggacccgtacctaggttcggtaccccaccgacgtaccggttaccggtagtaggggtaggggtcggggtttcggtcgggtacgggaccgtagggttaccgttacctacccttcaacccgaaacttcgtaaacgntaacccggtttatggacccgtaagggttacggggtaaaacgggtaaatttttttggttacgggaaacccttttttaaaacgttttaaagtttcggggtttacctaaacgggacctaaggggtttaaaaatttaacgggggtttaaaaaccccggggggccccgtccccttacgtttaacccgggtttaaccgggggtcccggggggaaaacggggttacccggggaaaaaacgtttgggggtaaaagggaaacttttaaaccgaaaacccggtaaaaacccgttgggtaggggttcccggtaaaccgtaccccgtaaaccttacgttcgtttaccggttacctttaacccgttaaccg

SEQ ID NO: 353026 - DNA, 562 bp, Homo sapiens
  misc_feature: GZ8MTXP02GRNIK.9.39.D06.1.454.CMB.2.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
  modified_base (364)..(364): a, c, t, g, unknown or other
  misc_feature (364)..(364): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgagggggaaangcccaccctntcctgcagggccagtcagagtgttagtagtaggttancctggcacagcaaaactggccagcctccaggctcctcatctatgatgcatccaccgaggacccactcggtcgtcccagccaggtcccaggtgggagtggggtctggggacnggtagtcactctcaccatcagcagtctgcagtacggaagtagtttgctagtttactagttgtacagtcagttagtaacggtaacgggccgtacgtccgtacgtttcgggacgggtacggggaccgtaaggggtaggaagactacgaaaacgtacgtaggtacggactcggaccacctacgtctcggttcttactaccc

SEQ ID NO: 353027 - DNA, 539 bp, Homo sapiens
  misc_feature: GZ8MTXP02I4TVP.9.39.D06.1.454.CMB.2.raw
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
  modified_base (358)..(358): a, c, t, g, unknown or other
  misc_feature (358)..(358): n is a, c, g, or t
  modified_base (396)..(396): a, c, t, g, unknown or other
  misc_feature (396)..(396): n is a, c, g, or t
  modified_base (442)..(442): a, c, t, g, unknown or other
  misc_feature (442)..(442): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagagtaggttancctggcaccagcaaaacctggccagcctcccaggctcctcatctatgatgcactccaccaggaccactggtactcccagccaggttccagtgggagtgggtctgggacngagttcactctcacatcagcagtctgcagtcggaagtntttgactagtttactattgtacagtcagttagtaagtaacgggccntacgtacgtttcggcggacgggaccgaagggtggaaggtactacgaaaacgtaccgtaggtcggacgtcggcacctacgtctcggttcttactaccg

SEQ ID NO: 353028 - DNA, 546 bp, Homo sapiens
  misc_feature: GZ8MTXP02FWHRQ.9.39.D06.1.454.CMB.2.raw
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
  modified_base (359)..(359): a, c, t, g, unknown or other
  misc_feature (359)..(359): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccacctctcctgcagggccagtcagagtgttagtagtaggttancctggcaccagcaaaacctggccagcctcccaggctcctcatctatgatgcatccaccaggacccactggtcgtcccagccaggttccagtcgggagtgggtctgggacngagttcactctcacatcagcagtctgcagtcgagtatttgcagtttactattgtcagcagtatagtaacggcgctctacgtttcggacggacgggaccaaaggggtcggaagacgttaacgaaaaccgtaaacgttggtcggaccgttaaggacctaacccgagttacctggttcctttactaaccg

SEQ ID NO: 353029 - DNA, 543 bp, Homo sapiens
  misc_feature: GZ8MTXP02G32NG.9.39.D06.1.454.CMB.2.raw
  modified_base (152)..(152): a, c, t, g, unknown or other
  misc_feature (152)..(152): n is a, c, g, or t
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (381)..(381): a, c, t, g, unknown or other
  misc_feature (381)..(381): n is a, c, g, or t
  modified_base (403)..(403): a, c, t, g, unknown or other
  misc_feature (403)..(403): n is a, c, g, or t
  modified_base (447)..(447): a, c, t, g, unknown or other
  misc_feature (447)..(447): n is a, c, g, or t
  modified_base (507)..(507): a, c, t, g, unknown or other
  misc_feature (507)..(507): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactgganaaatagtgatgacgcagtctccagcccacctggctgtgtctccgaggggaaancgccaccctntcctgcagggccagtcagagtgttagtagtaggttagcctggcacagcaaaacctggccagcctcccaggctcctcatctatgatgcatccaccaggacccactggtcgtcccagccaggttcccagtcgggagtggggtctgggacaggtagttcactcgtcacntcagcagtctgcagtcgaagtnttttggactagtttactattgtcagtcagtatagaacggccgtntcgtacgtttcggacgggtagggaccgtaagggtcggagacttacgaaacggtaactggnggactggacaaccgtcttcgtcgtacctttctaccc

SEQ ID NO: 353030 - DNA, 545 bp, Homo sapiens
  misc_feature: GZ8MTXP02J2PGW.9.39.D06.1.454.CMB.2.raw
  modified_base (205)..(205): a, c, t, g, unknown or other
  misc_feature (205)..(205): n is a, c, g, or t
  modified_base (360)..(360): a, c, t, g, unknown or other
  misc_feature (360)..(360): n is a, c, g, or t
  modified_base (449)..(449): a, c, t, g, unknown or other
  misc_feature (449)..(449): n is a, c, g, or t
  modified_base (515)..(515): a, c, t, g, unknown or other
  misc_feature (515)..(515): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangccaccctctcctgcagggccagtcagagtgttagtagtaggttagcctggcaccagacaaaacctggccagcctcccaggctcctcatctatgatgcatccacaggaccactggtctccagcctaggttccaggtgggagtcgggtctgggacnggattcgactctccacatcagcagtctgacgagtcggaatagtttgacttagtttactagttgtcagtcagtagtacggtacgcgtacncgtacgttcgggacgacgggaccgtagggtggagtactaacgaaaccgtaagttcggaggttaccncgacctacgtacttcgtacgttacttctcg

SEQ ID NO: 353031 - DNA, 516 bp, Homo sapiens
  misc_feature: GZ8MTXP02FPO83.9.39.D06.1.454.CMB.2.raw
  modified_base (204)..(204): a, c, t, g, unknown or other
  misc_feature (204)..(204): n is a, c, g, or t
  modified_base (361)..(361): a, c, t, g, unknown or other
  misc_feature (361)..(361): n is a, c, g, or t
  modified_base (429)..(429): a, c, t, g, unknown or other
  misc_feature (429)..(429): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaacctggccagcctcccaggctcctcatctatgatgcatccaccaggacccactggtgtccccagcccaggttccagtgggagtgggtctgggacngagtcactctcacatcagcagtctgcagtcggaagtattttgctagtttactattgtcagcagttaanagtaacgggccgctcacgtttcggcggtagggaccaaagggtggaagatacaaacgaactggtagctgccaccgatcctgtcttcac

SEQ ID NO: 353032 - DNA, 608 bp, Homo sapiens
  misc_feature: GZ8MTXP02I0PXF.9.39.D06.1.454.CMB.2.raw
  modified_base (204)..(204): a, c, t, g, unknown or other
  misc_feature (204)..(204): n is a, c, g, or t
  modified_base (364)..(364): a, c, t, g, unknown or other
  misc_feature (364)..(364): n is a, c, g, or t
  modified_base (391)..(391): a, c, t, g, unknown or other
  misc_feature (391)..(391): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaaangccaccctctcctgcagggccagtcagagtgttagtagtaggttagcctggcacagacaaaacctggccagcctcccaggcctcctcatctatgatgcactccaccaggacccactggtcgtccagccaggttccaggtgggagtggggtcgtgggacgngtgttcacgtctccacatcagcagtcngcagtacggtatatttgactagtttacttagttgtacgagtctaggttacgtaaggtaaccggccgtacgtaccgttacggtttccggggacggggtacggggtaacccgtaaaagggggttcggaaacggtacgttaaaccgaaaacggttaacgtacgggttcggacgttaacggaccaacccttagttccgttacgtttacctttcttaacccg

SEQ ID NO: 353033 - DNA, 585 bp, Homo sapiens
  misc_feature: GZ8MTXP02FXCVP.9.39.D06.1.454.CMB.2.raw
  modified_base (205)..(205): a, c, t, g, unknown or other
  misc_feature (205)..(205): n is a, c, g, or t
  modified_base (370)..(370): a, c, t, g, unknown or other
  misc_feature (370)..(370): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccagggggaaangccaccctctcctgcagggccagtcagagtgttagtagtaggttagcctggcaccagacaaaacctggccagcctcccaggcctcctcatctatgatgcatcccaccaggacccacgtcggtctccccagccaggttcccaggtgggagtgggtctggggacagngttcactcctcaccatcagcagtctgacaggtcggaagtattttgctagtttactatttgtacagtctaagttagtaacggtaaccgggccgtactcgtaccgtttcgggacgggtaacggggaccgtaaaggggttaggaaacgtacgtaacgaaaacggtacgtaggtacggacgtcggaccaacctagttccttacggtacctttactaacc

SEQ ID NO: 353034 - DNA, 628 bp, Homo sapiens
  misc_feature: GZ8MTXP02H7D58.9.39.D06.1.454.CMB.2.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccgaggggaaangcccaccctntcctgcagggccagtcagagtgttagtgtaggttncctggcaccagacaaaacnggcagcctccagctccncatctatgatgcatcccaaccaggacccacgtggtcgtccccgagcctaggttcccaggtcggggaggtgggtcgtggggactggacgttcactctcaccatcagcagtctgcgagtacggtaagttagtttgacttagtttactagtttgtcgagtcgtaagttagtaacggtaaaccgggcctaaccgttaccgtacggttttaccggggaccgggttaacggggaacccgtaaaggggtgggaaacggtaacgtaaccgaaaaaccggtacgtacgggttacggaccgttaacgaccgtaaacccgtagttcgttaccgtttctttacccgttacccg

SEQ ID NO: 353035 - DNA, 546 bp, Homo sapiens
  misc_feature: GZ8MTXP02HPVLW.9.39.D06.1.454.CMB.2.raw
  modified_base (207)..(207): a, c, t, g, unknown or other
  misc_feature (207)..(207): n is a, c, g, or t
  modified_base (364)..(364): a, c, t, g, unknown or other
  misc_feature (364)..(364): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccacctggctgtgtctccgaagggggaaancgccaccctctcctgcagggccagtcagagtgttagtagtaggttagcctggcacagacaaaactggcagcctcccagctcctcatctatgatgcatccaacacggaccactggtctaccagccaggttccgaggtgggaggtgggtcgtggggacngtagttcactctacacatcagcagtctgcgagtacgaagtatttgacttagtttactattgtcagtctagtaagtacggtaacggcctctacgtacgttcggcggaacgggaccgtaagggtgaagactaacggaaaacgtagtcgtaggctaacgacaacctatcctgtactttacgtacc

SEQ ID NO: 353036 - DNA, 567 bp, Homo sapiens
  misc_feature: GZ8MTXP02JEZXM.9.39.D06.1.454.CMB.2.raw
  modified_base (204)..(204): a, c, t, g, unknown or other
  misc_feature (204)..(204): n is a, c, g, or t
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
  modified_base (360)..(360): a, c, t, g, unknown or other
  misc_feature (360)..(360): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaaancgccacctctcctgcagggccagtcagagtgttagtagtaggttanctggcacagacaaactgccagcctccagctccncatctatgatgcatccacgacggacccacgtggtcgtccagccgtaggttccaggtgggagtcggggtcgtgggacnggtacgttcacgtctacactatcacgcagtctcgactagggtacgaagttattttggacttagtttacttagttgtacgtagtactagttagtaacggtaaccgggctctacgtacgttcgggacggtaggaccgtaagggtcggaagtacgtaacgaaacgtacgtgtggactcggacctaacgtacttctcgttacttactaccg

SEQ ID NO: 353037 - DNA, 523 bp, Homo sapiens
  misc_feature: GZ8MTXP02GC1SM.9.39.D06.1.454.CMB.2.raw
  modified_base (204)..(204): a, c, t, g, unknown or other
  misc_feature (204)..(204): n is a, c, g, or t
  modified_base (362)..(362): a, c, t, g, unknown or other
  misc_feature (362)..(362): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaangccaccctctcctgcagggccagtcagagtgttagtagtaggttagcctggcaccagcaaaacctggccagccctcccaggctcctcatctatgatgcatccaccaggacccactggtcgtcccagccaggttcccagtgggagtggggtctgggacngagttcactctcaccatcagcagtctgcagtcggatattttgctagtttactattgtcagtcagtataggtaacgggccgtctcgtacgtttcgggcggtagggaccaagggtcggagactacgaaacgacgtagtggctcgcacgtatctagttctctac

SEQ ID NO: 353038 - DNA, 591 bp, Homo sapiens
  misc_feature: GZ8MTXP02JLGHS.9.39.D06.1.454.CMB.2.raw
  modified_base (206)..(206): a, c, t, g, unknown or other
  misc_feature (206)..(206): n is a, c, g, or t
  modified_base (254)..(254): a, c, t, g, unknown or other
  misc_feature (254)..(254): n is a, c, g, or t
  modified_base (370)..(370): a, c, t, g, unknown or other
  misc_feature (370)..(370): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgagggggaaancgcccaccctctcctgcagggccagtcagagtgttagtagtaggttanccgtggcaccagcaaaacctggccagcctccaggctcctcatctatgatgcatccaccacggaccacgtggtcgtcccagcctaggttcccgaggtggggagtgggtctggggacnggtagttcactctcaccatcagcagtcgtgcgtagtacggaagttgttttgacttagtttacttaagttgtacagtacagttacgtaaggtaaccgggccgtacttacgtacgtttccggggacgggaacgggtaccgaaggggttggacgtaacgtaccgaaaaccggaagttcggttcggcgtaacggactacctacgtcttacggtccttacttcccg

SEQ ID NO: 353039 - DNA, 568 bp, Homo sapiens
  misc_feature: GZ8MTXP02J2FT9.9.39.D06.1.454.CMB.2.raw
  modified_base (205)..(205): a, c, t, g, unknown or other
  misc_feature (205)..(205): n is a, c, g, or t
  modified_base (367)..(367): a, c, t, g, unknown or other
  misc_feature (367)..(367): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangccaccctctcctgcagggccagtcagagtgttagtagtaggttagcctggcaccagacaaaacctggaccagcctcccaggctcctcatctatgatgcatccacacggaccagtggtctcccagcctaggttcccaggtggggagtggggtcgtggggacnggagttcactcgtcactatcagcagtctgcagtcggatatttgacttagtttactattgtcagtctagtagtaacggtacgccgtctacgtacgttcgggacggtaacggaaccgtaggggtaggaacgacgtaacgaaacggtacgtacggtcgggtactaaggaccgtaacctagttccgtacggttcctttacgtccc

SEQ ID NO: 353040 - DNA, 610 bp, Homo sapiens
  misc_feature: GZ8MTXP02G97BB.9.39.D06.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccatggagaaatagtgatgacgcagtctccagccacctggctgtgtctccgagggggaaangccaccctntcctgcagggccagtcagagtgttagagtaggttagcctggcaccagacaaaactggaccagcctcccaggcctcctcatctatgatgcatccaccaggacccacgtcggtcgtccccagtcccgaggttcccgaggtggggtaggtggggtcgtaggggacagggtagtttcgaaccttctccaaccattcaacgctaggtctgactagtacggaaagtacttttggacttagtttactagttgtcagtcagtataacggtaacggccgtacttcgtacgtttcgggacgggtagggaaccgtaaggggtcggaagaacgttaaccgaaaacggtaccgtagggtacggtacgtaacggactacccgtattccgttcggttacctttacgtacccg

SEQ ID NO: 353041 - DNA, 676 bp, Homo sapiens
  misc_feature: GZ8MTXP02IGUX3.9.39.D06.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccacctggctgtgtctccgaggggaaanagccaccctntccngcagggccagtcagagtgttagtagtaggttancctggcacagacaaaactggcagcctcccaggctcctcatctatgatgcatccacagaccatggctccagcctaggttccaggtggaggtgggtcgtgggacaggtagttcacctcctaccacatcacgtacagtctgaccgtaagtacgggtaaagttacgtttttacggaccgttaaaggttttaaccttagtttacggttaccgtaaggtaccgttaaggtttaagttaaacggggttaaacccggggcccgttacgtttaacccgttaccggtttttacgggggacggggtaaaccggggtaaaccggtaaacggggttggaaacggtaattaaaccggaaaaacggtaccgttagggtacggtacttaacgggaaccgtaacccgtagttaccttacggttaccttttaccgtaacccg

SEQ ID NO: 353042 - DNA, 517 bp, Homo sapiens
  misc_feature: GZ8MTXP02IGZJZ.9.39.D06.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (424)..(424): a, c, t, g, unknown or other
  misc_feature (424)..(424): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccatggagaaatagtgatgacgcagtctccagccacctggctgtgtctccgagggggaaangccaccctntcctgcagggccagtcagagtgttagtagtaggttagcctggcaccagcaaaacctggaccagcctcccaggctccncatctangatgcatccaccaggaccacgtggtctcccagccaggttccaggtggagtggggtctgggacnggngttcactctcacatcagcagtctgcagtcgagtatttgctagttctattgtcagtcagtanagtacgggctctcgtacgttcggacgggaggaccgtaaggtaggagagtacaaaacgacgtacggtgactgacacctatcgacgttctatccc

SEQ ID NO: 353043 - DNA, 593 bp, Homo sapiens
  misc_feature: GZ8MTXP02HQN2J.9.39.D06.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (410)..(410): a, c, t, g, unknown or other
  misc_feature (410)..(410): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctcgaaggggaaangccaccctntcctgcagggccagtcagagtgttagagtaggtancctggcacagacaaaactgacagcctcccagctccncatctangatgcactccaacgagaccacgtggtcgtcccagccgtaggtccgaggtcggggtagtggggtcgtaggggactaggtagttcaactctacacatcagtcagtctgcgagtcggaagtntttggaacttagtttactagttgtacgtagtcgtaaagttaaggtacgggttaaaccgggccgtacgttaccgttaacggttccgggacgggaaacggggtaacgagggtacggaagaacgtacgaaaacgtacgtaggtcgggtactaacgacaacctagttcttcgttacctttcgtaccc

SEQ ID NO: 353044 - DNA, 531 bp, Homo sapiens
  misc_feature: GZ8MTXP02IS3Y4.9.39.D06.1.454.CMB.2.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
  modified_base (365)..(365): a, c, t, g, unknown or other
  misc_feature (365)..(365): n is a, c, g, or t
  modified_base (445)..(445): a, c, t, g, unknown or other
  misc_feature (445)..(445): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccaggggaaangccaccctctcctgcagggccagtcagagtgttagtagtaggttancctggcaccagacaaaactggccagcctccaggctccncatctatgatgcactccaccaggacccacgtggtcgtcccagccaggttccaggtggggagtggggtcgtgggacngtagtcactctcacatcagcagtctgcagtcgaagtattttgactagttacttattgtcagctagtatagtaaccgggcnctcgtacttcgggacggagggaaccaagggtggagactacgaaaacgtacgtagtggtctggacctaccgattctacgtcttctac

SEQ ID NO: 353045 - DNA, 581 bp, Homo sapiens
  misc_feature: GZ8MTXP02J0S77.9.39.D06.1.454.CMB.2.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangccaccctctccngcagggccagtcagagtgttagtagtaggttagcctggcaccagacaaaacctggccagcctcccaggctcctcatctatgatgcatccaccaggaccactggtcgtcccagccgaggttcccgaggtgggagtggggtctgggacngtagttcactctcacatcagcagtctgcagtcgaagtntttgacttagtttactattgtcaggtctagttagtacggtaacgggccgtactcgtaccggtttcgggacggggtaacgggaaccgtaaagggtggaacgtacgttaaacgaaaacggtaacgtggttaacggcgttaacggacctaaccgtattcccgttggttaccttactacccg

SEQ ID NO: 353046 - DNA, 516 bp, Homo sapiens
  misc_feature: GZ8MTXP02JPSLJ.9.39.D06.1.454.CMB.2.raw
  modified_base (206)..(206): a, c, t, g, unknown or other
  misc_feature (206)..(206): n is a, c, g, or t
  modified_base (252)..(252): a, c, t, g, unknown or other
  misc_feature (252)..(252): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgagggggaaangccaccctctcctgcagggccagtcagagtgttagtagtaggttancctggcacagacaaaactggccagcctcccagctcctcatctatgatgcatccaccaggaccactggtcgtcccagccaggttccaggtgggagtgggtcngggacnggtagtcactctcacatcagcagtctgcagtcggaagtntttgctagttactagtntacagctagtagtagtacggcgtctctacgttcggcggtacgggactagggtgagactacgaaacgacgtgtaggctgccaacgactcgtcgtcttactac

SEQ ID NO: 353047 - DNA, 543 bp, Homo sapiens
  misc_feature: GZ8MTXP02GYVMO.9.39.D06.1.454.CMB.2.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccaggggaaangccacctntcctgcagggccagtcagagtgttagtagtaggttancctggcacagcaaaacctggccagcctcccaggctcctcatctatgatgcatccacaggacccactggtcgtccagccagttcccagtgggagtgggtctgggcngagttcactctaccacatcagcagtcngcagtcgagtatttgctagtttactattgtcagtctagtataacgttaacgggcctactacgtactttcggacgggtagggaccctaagggtcggaagtacgtaccgaaagtacgttagcgggcttaacggccaaccggtatacgttctccttacgttccg

SEQ ID NO: 353048 - DNA, 535 bp, Homo sapiens
  misc_feature: GZ8MTXP02HML2H.9.39.D06.1.454.CMB.2.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccaggggaaangccaccctctcctgcagggccagtcagagtgttagtagtaggttancctggcaccagcaaaacctggccagcctcccaggctcctcatctatgatgcatccacaggaccactggtcgtcccagccaggttccaggtgggagtgggtctggggacnggagttcactctcaccatcagcagtctgcagtcggaagtnttttgctagtttactattgtcagtctagtagtagtaaccgggccgtactcgtacgtttcgggacgggtagggaccgtaagggtcggagtacgtacgaaaacgactggtaggctaagcaccgatctcgtcttacac

SEQ ID NO: 353049 - DNA, 592 bp, Homo sapiens
  misc_feature: GZ8MTXP02G5ZLN.9.39.D06.1.454.CMB.2.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
  modified_base (436)..(436): a, c, t, g, unknown or other
  misc_feature (436)..(436): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccgagggggaaangccaccctntcctgcagggccagtcagagtgttagtagtaggttancctggcacagacaaaacctggccagcctcccaggcctcctcatctatgatgcactccaccacggacccacgtggtcgtcccagccgaggttcccaggtggggagtcggggtcgtaggggacgtaggtacgttcaaccttccgtcctaccgatccagctagtctggacgtaggtacggtaagtnttttgacgttagtttactagttgtcagtctagtagtaggtaaccggtccgacgttccgtacggtttcgggacgggtacgggtaaccgaaggggtacggagtaacgtacgaaaacgacgtgtcgcgtgaccacgtactcgtacgttccttactaccg

SEQ ID NO: 353050 - DNA, 586 bp, Homo sapiens
  misc_feature: GZ8MTXP02JIXKP.9.39.D06.1.454.CMB.2.raw
  modified_base (205)..(205): a, c, t, g, unknown or other
  misc_feature (205)..(205): n is a, c, g, or t
  modified_base (368)..(368): a, c, t, g, unknown or other
  misc_feature (368)..(368): n is a, c, g, or t
  modified_base (434)..(434): a, c, t, g, unknown or other
  misc_feature (434)..(434): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccagggggaaanagccaccctctcctgcagggccagtcagagtgttagtagtaggttagcctggcaccagacaaaacctggccagccctcccaggctcctcatctatgatgcatccaccaggaccactggtcgtcccagccgaggttccaggtggggagtggggtcgtggggacnggagttcacgtctcaccatcagccagtcctgcagtcggaagtattttgcttagtttactagttgtnagtctagtaagtacggttaaaccggccgtacttcgtacgtttcggggacgggtaacggggaacccgtaaagggtgggaaggtaactacgaaaacggtacgtcgtaagggcttaacggaccaaccgtagtcctacggttacctttacgtaccg

SEQ ID NO: 353051 - DNA, 503 bp, Homo sapiens
  misc_feature: GZ8MTXP02JRHWE.9.39.D06.1.454.CMB.2.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (288)..(288): a, c, t, g, unknown or other
  misc_feature (288)..(288): n is a, c, g, or t
  modified_base (333)..(333): a, c, t, g, unknown or other
  misc_feature (333)..(333): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (489)..(489): a, c, t, g, unknown or other
  misc_feature (489)..(489): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtccccagataccatggagaaatagtgatgacgcagtctccagcccaccctggctgtgtctccgaggggaaancgccaccctctccngcagggccagtcagagtgttagtagtaggtagctgcacagacaaaacctggcagcctccagctcctnatctatgatgcatccacagaccacgtggctccagccgagtaccgngtggagtgggtacgtgggacagtacgtcactctacgacatcagctagtnacgnagtacgagtnttgctagtttacnttgcagnagtagagtacggcgactcgtacgttcgacggtaggaccgaaggtgagacgacaacgatgagctaagctaacgntcgtactctctacc

SEQ ID NO: 353052 - DNA, 624 bp, Homo sapiens
  misc_feature: GZ8MTXP02J1EUP.9.39.D06.1.454.CMB.2.raw
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagcccaccctggctgtgtctccgaaggggaaancgcccaccctctcctgcagggccagtcagagttgttagtagtaggttancctggcaccagacaaaacctggccagccctcccaggctcctcatctatgatgcactcccaccgacggacccacgtcggtcgtccccagcccgtaggttcccgaggtggggaggtggggtcgtggggactggtacgttcgactcgtacacctatcacgtcagtcctgcgagtacggaagtgttttgacttagtttaccttagttgttaccagtactaaggttaacgttaggtaaccggccgtacgtccgtaacgtttcggggacgggtacggtaccggaagggttaggaacgacgttaaacgaaaacggtaacgtcggtaacgtcgttaaggacccaaccgttactccgttacgtccttacgttacccg

SEQ ID NO: 353053 - DNA, 617 bp, Homo sapiens
  misc_feature: GZ8MTXP02FUU8M.9.39.D06.1.454.CMB.2.raw
  modified_base (206)..(206): a, c, t, g, unknown or other
  misc_feature (206)..(206): n is a, c, g, or t
tcagtgatacgtctcacgaccggtgctcgatttagtgacatctcgcagttctttgggggaggaactgctcagttaggacccagacggaaccatggaagcccccagcgcagcttctcttcctcctgctactctgggtcccagataccactggagaaatagtgatgacgcagtctccagccaccctggctgtgtctccgaggggaaangcccaccctctcctgcagggccagtcagtagtgttagtagtaggttagcctggcaccagacaaaaaccgtggaccagccctcccaggcctcctcatctatgatgcatccaccaggacccacgtggtcgtcccgagccgtaggttccaggtggggaggtggggtcgtaggggactaggtacgttcacgtcctaccacccgtatccagctagtcagccgagttacggaagttagtttcgtcttaagtttacttagtttcgtactacggtactagttaacgtaggtaaacccggccgtacgtcgtacgtttcgggacgggaacggggtaccgtaaagggtcggagtaacgtaaccgaaacgtaaccgtgtcggacgtcggaccacccgttatccgtttacgtcttacttacccg

SEQ ID NO: 353054 - DNA, 575 bp, Homo sapiens
  misc_feature: GZ8MTXP02FKNR0.9.39.D06.1.454.CMB.2.raw
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
  modified_base (372)..(372): a, c, t, g, unknown or other
  misc_feature (372)..(372): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgaggggaaangcccaccctctcctgcagggccagtcagagtgttagtagtaggttancctggcaccagacaaaacctggccacgcctcccaggctcctcatctatgatgcatccaccacgaccacgtggtcgtcccagccgtaggttccgaggtggggaggtggggtcgtgggacgngtcgttcactctcacatcagctagtctgctaggtacgacgttattttcgacttagtttactattcggtactagactagttaagtaacggtaaccgggccgtacgttccgtacgtttcggggacgggtacgggaaccgtaagggtgagactaacgaaacgtacgtaggtcggtagtcgacactcgttactcgttacttactacc

SEQ ID NO: 353055 - DNA, 561 bp, Homo sapiens
  misc_feature: GZ8MTXP02IQM3A.9.39.D06.1.454.CMB.2.raw
  modified_base (208)..(208): a, c, t, g, unknown or other
  misc_feature (208)..(208): n is a, c, g, or t
  modified_base (363)..(363): a, c, t, g, unknown or other
  misc_feature (363)..(363): n is a, c, g, or t
  modified_base (401)..(401): a, c, t, g, unknown or other
  misc_feature (401)..(401): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgcctactctgggtcccagataccactggagaaatagtgatgacgcagtctccagcccaccctggctgtgtctccgagggggaaancgccaccctctcctgcagggccagtcagagtgttagtagtaggttagcctggcacagacaaaaacctggccagcctccaggctcctcatctatgatgcatccacacggacccactcggtgtcccagccaggttccagtggagtgggtctgggacnggagttcactctcacatcagcagtctgcagtcgaagtntttgactagtttactatttcgtacagtctagttacgtaaggtaaaccgggccgtcgtacgtacgtttcggggacggtacggggaaccaggggttacggagaacgtacgaaaacgtacgtaaggtcggcctaagcaacctacgtcctagttcctacgtacg

SEQ ID NO: 353056 - DNA, 595 bp, Homo sapiens
  misc_feature: GZ8MTXP02G9AEE.9.39.D06.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (366)..(366): a, c, t, g, unknown or other
  misc_feature (366)..(366): n is a, c, g, or t
  modified_base (442)..(442): a, c, t, g, unknown or other
  misc_feature (442)..(442): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccacctggctgtgtctccgaggggaaangccaccctntcctgcagggccagtcagagtgttagtagtaggttancctggcacagacaaaactggccagcctccagctcctcatctatgatgcactccaccgagaccacgtggtcgtcccagccctaggttcccaggtgggtacgtggggtcgtggggacnggaacgtttcgacctctacacatccagcagtctgcaagtcggaagtattttgacttaagtttattaagttcgttanacgtatagtagtaacgtaccgtccgtactacgtacggttaccgggacgggtaacggaacggtaacgggtacggaacgtaacgtaaaccgaaaacggtacgtacggtacggtactaacgacctaacctacgtacgttcgttaccttacgtaccg

SEQ ID NO: 353057 - DNA, 518 bp, Homo sapiens
  misc_feature: GZ8MTXP02FQ898.9.39.D06.1.454.CMB.2.raw
  modified_base (206)..(206): a, c, t, g, unknown or other
  misc_feature (206)..(206): n is a, c, g, or t
  modified_base (328)..(328): a, c, t, g, unknown or other
  misc_feature (328)..(328): n is a, c, g, or t
  modified_base (361)..(361): a, c, t, g, unknown or other
  misc_feature (361)..(361): n is a, c, g, or t
  modified_base (496)..(496): a, c, t, g, unknown or other
  misc_feature (496)..(496): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccgagggggaaangccaccctctcctgcagggccagtcagagtgttagtagtaggttagcctggcacagcaaaactggccagcctcccaggctctcatcatttgatgcatccaccaggacccactggtcgtcccngccaggttcccagtgggagtgggtcgtgggacngagttcactctcaccatcagcagtctgcagtcgagtatttggctagtttactatttgctagctagtagtaggtaacgggccgtctctacgtttcggacggagggaccgaaggtcggagactacgaaacgactggngctgcacactcgtctctctacc

SEQ ID NO: 353058 - DNA, 561 bp, Homo sapiens
  misc_feature: GZ8MTXP02HTG41.9.39.D06.1.454.CMB.2.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (441)..(441): a, c, t, g, unknown or other
  misc_feature (441)..(441): n is a, c, g, or t
tcagtgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctcagccacctggctgtgtctcgagggaaangccacctnctgcaggcagtcagagtgttagagtacgtancctgcacagacaaactggcagcctccaggctccncatctatgatgacatccacgacggaccacgtcggtcgtacccagccgtaaggtcccgaagggtggggtaggtgggtcgtaggggactaggtacgtttcacgtctacaccatcacgcagttccngngacgtacggaattntttggaccttagtttacctagttcgtanaagtctaagttacgacggtaacgggcctacgtctaacggtttcggacggaacgggtacctaagggagacgatacgaaacgtaacgtgtacggctggacaccgtagtctcgtcttacctcg

SEQ ID NO: 353059 - DNA, 631 bp, Homo sapiens
  misc_feature: GZ8MTXP02FN7AT.9.39.D06.1.454.CMB.2.raw
  modified_base (206)..(206): a, c, t, g, unknown or other
  misc_feature (206)..(206): n is a, c, g, or t
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
  modified_base (367)..(367): a, c, t, g, unknown or other
  misc_feature (367)..(367): n is a, c, g, or t
  modified_base (596)..(596): a, c, t, g, unknown or other
  misc_feature (596)..(596): n is a, c, g, or t
tcagtgatacgtctcacgaccggtgctcgatttagtgacatctcgcagttctttggggggaggaactgctcagttaggacccagacggaaccatggaagccccagcgcagcttctcttcctcctgctactctgggtcccagataccatggagaaatagtgatgacgcagtctccagcccacctggctgtgtctaccgaggggaaancgcccacctctccgtgccgagggccagtcagtagtgtagtagtaggtanctgcacagacaaactgacagcctccagctctcatctangatgcactccaccagacctacgtggtctcccgagccgtaggttcccagggtaggtaggttggggtcgagggacnggtattcgactcctacaccatacgacgtctacgttcgacgcgtacgggtacggtaagtttacgtttcggtaccttaaaggttttacttaaggtttacgtaccgaggtaaccgttaaggttaacgggtaaacggtaacccggggccgttacgtacgttaacggtttcggggaacgggtagggaaccgtaagggtggaagttaacgaacgaaaacgtacgtcgacggtacncggacctaactagttacgtacttccgtcttacccg

SEQ ID NO: 353060 - DNA, 525 bp, Homo sapiens
  misc_feature: GZ8MTXP01D4PUD.4.33.C11.1.454.CMB.2.raw
  modified_base (237)..(237): a, c, t, g, unknown or other
  misc_feature (237)..(237): n is a, c, g, or t
  modified_base (414)..(414): a, c, t, g, unknown or other
  misc_feature (414)..(414): n is a, c, g, or t
  modified_base (448)..(448): a, c, t, g, unknown or other
  misc_feature (448)..(448): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagtgttaanatacagctaccaacaatgagaactacttagcttggtatcagcaagaaaccaggacagcctactaagctgctcatttaccgggcacgccgtaaccccccgggaatccgggggtccctgacgccgaattcagtggcagcgggtctgggacagatttcactctcaccatcagcagcctgnagcgtagaagagtgtgcgtagttattactgtcanctaataattcttactacttccgtcgtacgttcggttcggacgggaaccgaaggtggagagttacaacgaacgtaagg

SEQ ID NO: 353061 - DNA, 509 bp, Homo sapiens
  misc_feature: GZ8MTXP01EQDZ4.4.33.C11.1.454.CMB.2.raw
  modified_base (320)..(320): a, c, t, g, unknown or other
  misc_feature (320)..(320): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (497)..(497): a, c, t, g, unknown or other
  misc_feature (497)..(497): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaacaatgaagaactacttagcttggtatcagcaagaaacccaggacagcctactaagctgctcagtttaccggnagccgtaacccccgggatccggggtccctgacgcggacttcgagtagggcacgcggtacgnggacagatcnctcncacacncancacncngngngngagagagtgngtgtagttattactntnanatataatacttactacttcgtcgtcgttcggcggacggaacgaggaagaganactaacgaagtg

SEQ ID NO: 353062 - DNA, 539 bp, Homo sapiens
  misc_feature: GZ8MTXP01ET063.4.33.C11.1.454.CMB.2.raw
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (440)..(440): a, c, t, g, unknown or other
  misc_feature (440)..(440): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctatttaaaggtgtcaatgtgaggtgcagctggtggagtcgtgggggagcttggtccagccagggcggtccctgagactctcctgtacagcgtctggattcaacttcgngattatgccatgaactgggtccncaggctcgagggaagggctggagtgggtaggttcattagagcatggctatgctagggacaacagaaatacgccgngtctgtagaaggcagattcatcatctaanaaganatagtactacgacggctactcactatcngacagatagaacacgcaagaacgacggaacgacgacgacgttacgttcttattaacgtaggttaaggttagggttagtttaggttaagttttgggtaag

SEQ ID NO: 353063 - DNA, 492 bp, Homo sapiens
  misc_feature: GZ8MTXP01BVUSB.4.33.C11.1.454.CMB.2.raw
  modified_base (434)..(434): a, c, t, g, unknown or other
  misc_feature (434)..(434): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtatatacagctcaacaatgagaactacttagcttggtatcagcagaaaccaggacagcctctaagctgctcatttaccgggcagcctacccccgggatccggggtcctgagcgattcgagtggcaggcgggtctgggacagattcactctcacatcagcagcctgcaggctgaagatgtggctagtttatactgtcagcaatnttcttactacttcgtcggactttcggcggaggaacaggtgagattacaacgaacgtgg

SEQ ID NO: 353064 - DNA, 559 bp, Homo sapiens
  misc_feature: GZ8MTXP01EJIYL.4.33.C11.1.454.CMB.2.raw
  modified_base (359)..(359): a, c, t, g, unknown or other
  misc_feature (359)..(359): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggagcttggtccagccagggcgtccctgagactctcctgtacagcgtctggattcaacttcgtgattatgccatgaactgggtcccgcaggctccgaggggagggctggaggtgggtagttcattagagccatggacttangctaagggacaacgagaaactacgccgcgtctgtagaaggcagattcatcatctacaagagatagacttcccgaaacgggggctaagtccgcctatcctgcagatagaacagcctaagaacgaccggaaggacacgacgccgttcttacgttaactggttggtttaagggttaggttttagttaagtttttgggtaaggg

SEQ ID NO: 353065 - DNA, 633 bp, Homo sapiens
  misc_feature: GZ8MTXP01CHEE3.4.33.C11.1.454.CMB.2.raw
  modified_base (242)..(242): a, c, t, g, unknown or other
  misc_feature (242)..(242): n is a, c, g, or t
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtggggcgaggacgggccaccatacaactacaagtccagccagagtgtanatacagctaccaacaatagaagaaactactagcttaggtatcagacaagaaaccaggacacgccctacctaagctcgtctactacgtttaccggcacgaccgtaccgggaaccgtccggggtcctgagacgtaactcgngtggcgagggtcggtcgacggganacgtactttcacctctcaaccatacacgcacgctcgacgagtactagggaaagtacgtgtcgggattaacgttttagttacgtcggtacataactaacttattccttaaccgttaaccttccccggttaggttaacccgggtttcgggacccgggggttagggttaaacccggtaaggggttaggaaccggtaagtaaccgaaaaaccggttaaggttccgggttcgg

SEQ ID NO: 353066 - DNA, 583 bp, Homo sapiens
  misc_feature: GZ8MTXP01AHEOE.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctacaaacatgaagaactacttagcttggtatcagcaagaaaccaggacagcctactaagctgctctagttaccgggcacgccgtaacccccgggaacgtccggggtccctaggacgacgtaattccgaggtcgggacgacgggcggggtctaggggacctagtactttcactcctacaccatcagcacgcctgcaggcgtagaagtatggtggtctagtttactacgtgtacagtctaaattaacttccttacttaaccttcccgttaccgggtaaccgtttcggggacgggaacggggaaccgtaagggtcggaagtacgttacgaaacgttaacgtggg

SEQ ID NO: 353067 - DNA, 517 bp, Homo sapiens
  misc_feature: GZ8MTXP01A4IY3.4.33.C11.1.454.CMB.2.raw
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcaagaaaccaggacagcctactaagctgctcatttaccgggcagcctacccccgggaatccggggtccctgagcgattcgagtggcaggcgggtctgggacagtattcactctcaccatcagcagcctgcaggcgtagaaagtatggtggctagtttattacgtgtcagtactaataattcttactacttccgtcggtacttcggcggacggaacgaggtggagagttacgaacgaacgtgg

SEQ ID NO: 353068 - DNA, 581 bp, Homo sapiens
  misc_feature: GZ8MTXP01CVDYJ.4.33.C11.1.454.CMB.2.raw
  modified_base (250)..(250): a, c, t, g, unknown or other
  misc_feature (250)..(250): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttatatacagctaccaanaatgaagaactacttagcttggtatcagcaagaaaccaggacacgccctacctaagctgctctacgtttaccgggacacggaccgtaaccccccggggaacgtccgggggtccctggacgcgtaattcgaggtcgggacgagggccggggtctaggggacctagtactttaccactcctaccaacccataccgagcacgccgtgacgaggcgtaggaagtatggtggtctagtttattacgtgtacagactaataattacttacttaccttccgtacggtcgtttcgggcggacgggaaccgaagggtggagattacgtaaacgaacgtgg

SEQ ID NO: 353069 - DNA, 510 bp, Homo sapiens
  misc_feature: GZ8MTXP01ET2MO.4.33.C11.1.454.CMB.2.raw
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctactaagctgctcatttaccgggcagctaccccggaatccggggtccctgacgcgattcgagtggcaggcgggtctgggacagatttcactctcaccatcagcagcctgcaggctgaagatggtggctaggtttatactgtcagcaaataattcttactacttccgtcggtactttcgggcggacgggaaccaagggtggagtagactaacgaacgtgg

SEQ ID NO: 353070 - DNA, 514 bp, Homo sapiens
  misc_feature: GZ8MTXP01BIXUN.4.33.C11.1.454.CMB.2.raw
  modified_base (497)..(497): a, c, t, g, unknown or other
  misc_feature (497)..(497): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaaacaatgagaactacttagcttggtatcagcaagaaaccaggacagcctactaagctgctcagtttaccgggcagcctacccccgggaatccgggggtccctgagcgattcagtggcagcgggtctgggacagtatttcactctcacatcagcagcctgcaggctgaagatgtggctagtttattactgtcagcaataattcttactacttccgtcggtactttcggcggacgggaaccaagggtggagngttacaaacgaacgtgg

SEQ ID NO: 353071 - DNA, 533 bp, Homo sapiens
  misc_feature: GZ8MTXP01EKJNA.4.33.C11.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttatatacagctacaaanaatgaanaactacttagcttggtatcagcaaagaaaccaggacagcctactaagctgctcattaccgggcagccgtaccccgggatccggggtcctgacgcgattcgagtggcaggcgggtctgggacagtacttcactctacaccatcagcagcctgacgaggcgtagaaagagtggtaggctagtttatactgtcaagtacaattaacttcttaactaccgttcgtcggtacgttcggcggacgggaacgtaggtaaggagacgacgtaaacgaagtgg

SEQ ID NO: 353072 - DNA, 522 bp, Homo sapiens
  misc_feature: GZ8MTXP01BVGGY.4.33.C11.1.454.CMB.2.raw
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctccaacaatgagaactacttagcttggtatcagcaagaaaccaggacagcctacctaagctgctcatttaccgggcagcctacccccgggatccggggtcctgagcgattcgagtggcagcgggtctgggacagattcactctcacatcagcagcctcgcagcgtgagagtgtgcgtagttattactgtcgtagtacaataattacttactacttccgtcgtacgttcggttcggacgggtaacgacggtaaggaggagttacgtaacgaacgtaacgg

SEQ ID NO: 353073 - DNA, 511 bp, Homo sapiens
  misc_feature: GZ8MTXP01EYTFC.4.33.C11.1.454.CMB.2.raw
  modified_base (230)..(230): a, c, t, g, unknown or other
  misc_feature (230)..(230): n is a, c, g, or t
  modified_base (377)..(377): a, c, t, g, unknown or other
  misc_feature (377)..(377): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtnttatatacagctcaaacaatgagaactacttagcttggtatcagcaagaaaccaggacagcctacctaaagctgctcagtttaccggcacgccgtaaccccccgggaagtccggggtccctgacgcgattcgagtggcaggcgggtntgggacagatttcactctcaccatcagcagcctgcaggctagaagatgtggctagtttattactgtcagcaataacttcttactaccttcgtcggtacttcggcgacggcgaggtgagattacaacgaacgtgg

SEQ ID NO: 353074 - DNA, 514 bp, Homo sapiens
  misc_feature: GZ8MTXP01A5XQP.4.33.C11.1.454.CMB.2.raw
  modified_base (317)..(317): a, c, t, g, unknown or other
  misc_feature (317)..(317): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctcaacaatgagaactacttagcttggtatcagcaagaaaccaggacagcctacctaagctgctcatttaccgggnagctaccccgggatccggggtcctgagcgattcgagtggcaggcgggtctgggacagtattcactctcacatcagcagcctgcaggctgaagatgtggctagtttattactgtcagtactaataacttacttactaccttccgtcggtactttcgggcggacgggaacaagggtggagattacgaaacgaactaagg

SEQ ID NO: 353075 - DNA, 519 bp, Homo sapiens
  misc_feature: GZ8MTXP01BBZMQ.4.33.C11.1.454.CMB.2.raw
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctccaacaatgagaactacttagcttggtatcagcaagaaaccaggacagcctctaagctgctcatttaccgggcagcctacccccgggaatccggggtccctgacgcgattcgagtggcagcgggtctgggacagattcactctcacatcagcagcctgcgaggctaggaagtagtggtaggctagtttattactgtcagctaataacttcttactaccttccgtacggtactttcgggcggaggaaccgaggtggagacgttacaaacgcgtaagg

SEQ ID NO: 353076 - DNA, 548 bp, Homo sapiens
  misc_feature: GZ8MTXP01CD53X.4.33.C11.1.454.CMB.2.raw
  modified_base (376)..(376): a, c, t, g, unknown or other
  misc_feature (376)..(376): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaacaatgaagaactacttagcttggtatcagcaagaaaccaggacagcctacaagctgctcactttaccggcagcctaacccccgggaatccggggtccctggacgcgattcgagtcggcaggcgggtntgggacagtattcactctcacatcagcagcccgtgcgaggcgtaggaagtagtcgtggctagtttattacgtgtcagcaattaacttcttactacttccgtacggtcgtttacgggcgggaacgggaacccgtaagggtgggaacgtagttaccgtaaaacgaaccgttggg

SEQ ID NO: 353077 - DNA, 552 bp, Homo sapiens
  misc_feature: GZ8MTXP01A7O83.4.33.C11.1.454.CMB.2.raw
  modified_base (441)..(441): a, c, t, g, unknown or other
  misc_feature (441)..(441): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttatatacagctaccaacaatgaagaaactacttagcttaggtatcagacaagaaaccaggacacgcctactaagctgctcagtttaccgggcacggccgtaccccccggggaagtccgggggtccctgacgcgattcgaggtggcagggtcggggtctgggacagtattcactctcacatcaagcacgctgcgaggcgtagaagtntcggtgtctagtttattactgtacagtactaattcttccttactacttcccgtcggtacgttcgggcggacgggaaccgtaagggtggagacttacgaaacgttaagtcgg

SEQ ID NO: 353078 - DNA, 590 bp, Homo sapiens
  misc_feature: GZ8MTXP01A0IOD.4.33.C11.1.454.CMB.2.raw
  modified_base (457)..(457): a, c, t, g, unknown or other
  misc_feature (457)..(457): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaaacaatgaagaactacttagcttggtatcagacaagaaaccaggacacgcctactaagctgctcagtttaccgggcacgccgtaacccccggggaacgtccgggggtccctggacgcgtaagttcgagggtcgggcgacgggtcggggtcgtaggggactagtactttccactctacaccatcagcacgcctgcgaggcgtaggaaagngtggtgacgttagtttattacgtgtcagtactaattaacttacttaacctaccgttccgtacggtacgtttacggggcgggttaacgggaaccgtaagggtaaggaagtacgttaacgaaacgttaagtcggg

SEQ ID NO: 353079 - DNA, 500 bp, Homo sapiens
  misc_feature: GZ8MTXP01AQKFF.4.33.C11.1.454.CMB.2.raw
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggatcagcagaaaccaggacagcctcaagctgctcatttaccgggcagctacccccgggaatcggggtccctgagcgattcagtggcagcgggtctgggacagattcactctcacatcagcagcctgcaggctagaagatgtggctagtttatactgtcagcaataatcttactaccttccgtcggactttcggcggttagggaaccaaggtggagattacaaacgaacgttgg

SEQ ID NO: 353080 - DNA, 572 bp, Homo sapiens
  misc_feature: GZ8MTXP01C29NV.4.33.C11.1.454.CMB.2.raw
  modified_base (236)..(236): a, c, t, g, unknown or other
  misc_feature (236)..(236): n is a, c, g, or t
  modified_base (415)..(415): a, c, t, g, unknown or other
  misc_feature (415)..(415): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttanatacagctacaacaatgagaactactagcttggtatcagcaagaaaccaggacagcctactaagctgctactagtttaccgggcacgccgtaacccccggggaatccggggtccctgacgacgattcgagtgggcagggcgggtctgggacagtattcactctacacaatcagcagccngacgagacgtagaagtgtaggtgtacgtagtttacttacgtgtacacgtactaaattaacttacttacttaccgttccgttacggtacgtttcgggacgggttaacgggtaaccgtaagggtaacggtaacgaacgttaacgtaaacggttaacgtg

SEQ ID NO: 353081 - DNA, 558 bp, Homo sapiens
  misc_feature: GZ8MTXP01E1LEB.4.33.C11.1.454.CMB.2.raw
  modified_base (382)..(382): a, c, t, g, unknown or other
  misc_feature (382)..(382): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctacaacaatgaagaactacttagcttggtatcagacaagaaaccaggacacgcctactaagctgctcagtttaccggcacgccgtaacccccgggaagtccgggggtcctggacgcgtattcgaggtggcaggcgggtntgggacagtattcactctcacatcagcacgccctgcgaggcgtaggaagagtgtaggactagtttaacttacgtgtacagtactaaattcttacttacctaccttccgtacggttaccgttcgggcgggacgggtaaccgaagggtcgaaggtacttacgtaaacgttaacgtggg

SEQ ID NO: 353082 - DNA, 628 bp, Homo sapiens
  misc_feature: GZ8MTXP01C74FM.4.33.C11.1.454.CMB.2.raw
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtggggggagcttggtccagccgagggcggtccctgagactctcctgtacagcgtctggattcaactttcgngtattangccatgaactgggtcccncaggctcgaggggagggctgggagtgggtagttcagttagacgcatggcttagtcgcgtagggacaaacgagaaaactaccgcccgtcgtcgtaggtaggaaaggcagattcatcatctacaagagtatagtacttaccgaaacggctaactccgtaccttaactctacgacaagatacgaacacgtacctaggaaacgaccggaacggaacaaccgacggtacccgttacttaacgtttacgttagggttggtttaaggggtttaagtttttaacggttaagttttttagggtaggttaggttaacttaacgtttaaaccccg

SEQ ID NO: 353083 - DNA, 553 bp, Homo sapiens
  misc_feature: GZ8MTXP01BJWVR.4.33.C11.1.454.CMB.2.raw
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttcctgttgctattttaaaggtgtccaatgtgaggtgcagctggtggagtcgtgggggagcttggtccagccagggcgtccctgagactctcctgtacagcgtctggattcaacttcgtgattatgccatgaactgggtccnccaggctccgaggggaagggggctgggagtgggtaggtttcattagagccatggcttagngctaggggacaacagaaatacgccgngtctggtacgaaaggcagattcatcatctacaagagatgattaccaacggggcatcgctagtctgcagatagaacagcctaagaaacgaccggaaggacaacgacgccgttcttacttaactggttaaggtttagggtagttttaggtaagtttttgggtaagg

SEQ ID NO: 353084 - DNA, 660 bp, Homo sapiens
  misc_feature: GZ8MTXP01C4WPZ.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacgggacatcgtgatcgacccagtctccagacctccctggctgtgtctgtgggcgaggacgggccaccatcaactgacaagtccagccagtagtgttatatacagctacaacaatgaataactacttagtcttaggtatcagacaaagaaaccgaggacacgcctactaagctgctctacgtttaccggcacggccgtaacccccgggacgtccggggtcctgacgacgtattcgaggtcggcgtacgggcgggtcgtggggaactagttactttacacttcctaccaaccgactacgaacgccgaacggtccctacggacgtacgggtacgtaaggaaggtagtgggtacggtacttaggttttaacttacgtgttacaacgtacttaaattaactttacttaaccgttaccgttccggttacgggttaaccggtttccggggacggggttaaacggggtaacccgtaaaggggtaacggaacgtaacgttaaccggtaaacgttaacgttcgggg

SEQ ID NO: 353085 - DNA, 526 bp, Homo sapiens
  misc_feature: GZ8MTXP01DVFG3.4.33.C11.1.454.CMB.2.raw
  modified_base (395)..(395): a, c, t, g, unknown or other
  misc_feature (395)..(395): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccatcaactgcaagtccagccagagtgtatatacagctcaaacaatgaagaactacttagcttggtatcagcaagaaaccaggacagcctacctaagctgctcatttaccggcagcctacccccgggaatccggggtccctgagcgattcagtggcaggcgggtctgggacagattcactctcacatcancagcctgcaggctagaagatgtgctagtttatactgtacagacaaataattcacttacttccgtcggtaacctttcgggcgggaacgggtaaccgaaagggttgggagacgttacaaaccggaaacgtggg

SEQ ID NO: 353086 - DNA, 586 bp, Homo sapiens
  misc_feature: GZ8MTXP01AHYC1.4.33.C11.1.454.CMB.2.raw
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
tcagagcactgtagcacgaccggtgctcgatttagagtgagctcgttggggtttggggggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtggggggagcttggccagcccgagggcggtccctgagactctcctgtacagcgtctggattcaactttcgtgattangccatgaactgggtccgccaggctccgaggggaggggctgggagtgggtaggtttcattagagccatggcttancgctgggacaacagaaatacgccgcgtctgtagaaaggcagattcatcatctacaagagatgacttaccaacggcatcgcctatcctgcagatagaacacgccgtagaaacggacccggagggaaccaacgacggtacccgttcgtaactttaacgttggttggtttaggggttaaggttttaacggtaagtttttggggagttaggtaatttaacgtttaaccc

SEQ ID NO: 353087 - DNA, 861 bp, Homo sapiens
  misc_feature: GZ8MTXP01DVALF.4.33.C11.1.454.CMB.2.raw
  modified_base (242)..(242): a, c, t, g, unknown or other
  misc_feature (242)..(242): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactcccgtggctgtgtctcgtggggcgagacgggccaccatcaactgacaagtccagccagtagtgttanatacagctacaaacaatgagaactacttagcttggtatcagacaaacgaaaccaggacacgacccttactaagctcgtacctactacgtttacccgggacacggtacccggttaaacccccccggggaacggttccccgggggtaccctaggacggtacccggttaatttcggaacggttcggggaccgtaacggggtcccgggggttaccgttaggggggaaaccctaaacgggttaacgtttttcccgaacccgttttccctaccgaaaccccgtaaattcccgaaacgggtcccaacgggccccttccggtaccggtaacgggaccggggtaaacgggtaaacgggtaaacggttacgggttaggggttaaccggtttaacgggttttaaagttttaacctttacggttaaccgtaagtaaccgtaaagtttaaactttaacccgtttaaacccgtttaaccctttaccccggtttaacccggggtttaacccgggttttaccgggggttacccgggggttaaccgggggtaaaccccggggtaaacggggttaaacggggtaacgggtaaacggttaaaccggtaaaaccgggttaaaccgggtttaaaccgggg

SEQ ID NO: 353088 - DNA, 500 bp, Homo sapiens
  misc_feature: GZ8MTXP01DIJ2A.4.33.C11.1.454.CMB.2.raw
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (388)..(389): a, c, t, g, unknown or other
  misc_feature (388)..(389): n is a, c, g, or t
  modified_base (391)..(392): a, c, t, g, unknown or other
  misc_feature (391)..(392): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtatatacagctcaaacaatgagaactacttagcttggtatcagcagaaaccagacagcctctaagctgctcatttacggcagctacccccgggaatccggggtcctgagcgattcagtggcagcgggtcngggacagattcactcncacancancnncnnagngagagatgngntattattatntnananaataattcttactacttccgtcgtacgttcggttcggacgggaacggaaggtaaggaggagaacgtaacgaacgtaag

SEQ ID NO: 353089 - DNA, 517 bp, Homo sapiens
  misc_feature: GZ8MTXP01A2YQ7.4.33.C11.1.454.CMB.2.raw
  modified_base (478)..(478): a, c, t, g, unknown or other
  misc_feature (478)..(478): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctcaacaatgagaactacttagcttggtatcagcaagaaaccaggacagcctcctaagctgctcatttaccgggcagcctacccccggggaatccgggggtccctgagacgattcgagtggcaggcgggtctgggacagtattcactctcacatcagcagcccgcaggctagggaagagtgtggctagttattactgtcagactaatattctacttactcttcggtacttcgggcggnggaccgaaggtcggaagactacgaacgtaacgttgtcgg

SEQ ID NO: 353090 - DNA, 561 bp, Homo sapiens
  misc_feature: GZ8MTXP01BEYTF.4.33.C11.1.454.CMB.2.raw
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
  modified_base (430)..(430): a, c, t, g, unknown or other
  misc_feature (430)..(430): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaaggtgtccaatgtgaggtgcagctggtggagtcgtgggggagcttggtccagccagggcgtccctgagactctcctgtacagcgtctggattcaacttcgngattangccatgaactgggtcccncaggctccgaggggaagggctgggagtggggtagtttcagttagagccagtggacttanggctaaggggaacaacgagaaataccgccgcgtctggtagaaaggcagattcatcatctacaaganatagacttaccgaacggggcagtcgcctatctgcagatagaacacgcctaagaacgaccgaaggacacgaacgccgttcttattaaccgtgttaaggttaaggggtgtttaacgttaagtttttgggaagg

SEQ ID NO: 353091 - DNA, 568 bp, Homo sapiens
  misc_feature: GZ8MTXP01BJLHY.4.33.C11.1.454.CMB.2.raw
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaacatcaactgacaagtccagccagagtgttatatacagctaccaaacaatgaacgaactacttagcttggtatcagcaaagaaaccaggacacgcctactaagctcgctacagtttaccgggacacgaccgtaacccccgggaacgtccggggtccctggacgacgtattcgagtcgggacacgggcgggtgagggacagtattacactctacacatcagcagcctgacgacggacgtagaagtatgggtaggtactagtttattaccgtagtccagtactaagtaacttacttactacttcgtacggtacgttcgggcggaacggtaaccgagggtaagaggacacgtaaaccgaagtgg

SEQ ID NO: 353092 - DNA, 582 bp, Homo sapiens
  misc_feature: GZ8MTXP01DYKBI.4.33.C11.1.454.CMB.2.raw
  modified_base (488)..(488): a, c, t, g, unknown or other
  misc_feature (488)..(488): n is a, c, g, or t
  modified_base (530)..(530): a, c, t, g, unknown or other
  misc_feature (530)..(530): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggaggcttggtccagccgagggccggtccctgagactctcctgtacagcgtctggattcaacttcgtgattatgccatgaactgggtccgccaggctccgaggggaaggggctgggagttggggtaggtttcagttagagccagtgggtcttagtgcgtaggggaacaacgagaaactaccggccgcgtcgtgtagaaaggcagtattcatcatctacaagagatgtaacttacccgaacggggactagtccgaccctatcctgctaagntagaacagcctaagaaacgaccgacggacacgacgcccgttnttacttaacgtggttaaggtttagggtagttttagttgttttaagggtaagg

SEQ ID NO: 353093 - DNA, 665 bp, Homo sapiens
  misc_feature: GZ8MTXP01EB9EZ.4.33.C11.1.454.CMB.2.raw
  modified_base (216)..(216): a, c, t, g, unknown or other
  misc_feature (216)..(216): n is a, c, g, or t
tcagagcactgtagcacgaccggtgctcgatttagagtgagctcgttgggtttgggcttagctgggttttccttgttgctattttaaaaggtgtccaatgtgaggtgcagctggtggagtctgggggaggcttggtccagccagggcggtccctgagactctcctgtacagcgtctggattcaacttttcgtgatttatgccatgaactgggtccnccaggctccgagggaagggctggagtgggtagttcattagagccatggcttatgctgggaacaacagaatacgccgcgtctgtagaaaggcaagattcatcatctacaagagatgattccaaggcatccgcctatctgcaagatgaaacagccctagaacgaccgagacacagccgtctattactggttaggtttagggttagttttacgtagttttgggagttaggtaattaacgtttaaaccttaaacccccttaattttacgaaaccgttaccgtacgggggtacccgtaacgggggtaaccccttcgggtccgtccccgttccttcccttccgaacggtcccccttaccgaaaccccggaaacggggttcccccttacgttccccgggttccctttccccccgttcgggccccgtccccgttcggtcccgttcccggtaaccggg

SEQ ID NO: 353094 - DNA, 538 bp, Homo sapiens
  misc_feature: GZ8MTXP01EX6IZ.4.33.C11.1.454.CMB.2.raw
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
  modified_base (380)..(380): a, c, t, g, unknown or other
  misc_feature (380)..(380): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttcctgttgctatttaaaggtgtcaatgtgaggtgcagctggtggagtcgtgggggagcttggtccagccgagggcggtccctgagactctcctgtacagcgtctggattcaacttcgngattangccatgaactgggtccnccaggctccgagggaagggctggagtgggttagttcattagagccatggcttatgctagggacaacagaatacgccgngtctggtagaaagcagatcatctatctacaagagatgaattaccaacggggctacgtccgacctaatctgcaggatagaacagcctaagaacgaccggaggacacgacgccgttcttattaacgtgttgttagggtagtttagtaagttttggtaagg

SEQ ID NO: 353095 - DNA, 504 bp, Homo sapiens
  misc_feature: GZ8MTXP01DKD5L.4.33.C11.1.454.CMB.2.raw
  modified_base (437)..(437): a, c, t, g, unknown or other
  misc_feature (437)..(437): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcaagaaaccaggacagcctctaagctgctcatttaccggcagctacccccgggaatccggggtccctgagcgattcagtggcagcgggtctgggacagattcactctcaccatcagcagcctgcaggctgaagatgtggctagttattactgtcagcaatnttcttactacttccgtcggtactttcggcggagggaaccgaaggtggagattacgaaacgaacgtgg

SEQ ID NO: 353096 - DNA, 572 bp, Homo sapiens
  misc_feature: GZ8MTXP01CTV2Z.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaaccatcaactgacaagtccagccagagtgttatatacagctacaacaatgaagaactacttagcttggtatcagcaagaaaccaggacacgcctactaagctgctctagtttaccggcacgcgtaacccccggggatccggggtcctggacgacgattcgagtggacagggcgggtcagggacagtacttcactctaccacatcagcagcctgcgaggctagaagtagtgtgctaggtttatacctgtcagtactaataacgtttaccttacttaccgcgttaccggtacgtttaccggggcggttaacggggtaacccgaagggttcggaacggtacttacgtaaaaccgttaacgttaacggg

SEQ ID NO: 353097 - DNA, 595 bp, Homo sapiens
  misc_feature: GZ8MTXP01APTXU.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgcaagtccagccagagtgttatatacagctacaacatgaagaactacttagcttaggtatcagacaagaaaccaggacacgcctactaagctgctacacgtttacccgggcacggtccgtaacccccggggtaaccgtccgggggtccctaggacggtaccgtaagtttcgaaggtcgggacgacgggtccgggtgtaggggaactagtactttacactctaccactacgtcacgctacgcctagcgaggcgtagaagtcgtaggtgtcttagtttactacgtgtactagtactaattaatccttactaccttcgtacggtacgttcgggcgggttacggaaccgtagggtgaacgtagaacgtaacgttaacgtggg

SEQ ID NO: 353098 - DNA, 552 bp, Homo sapiens
  misc_feature: GZ8MTXP01BLT01.4.33.C11.1.454.CMB.2.raw
  modified_base (375)..(375): a, c, t, g, unknown or other
  misc_feature (375)..(375): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttaggtatcagcaagaaaccaggacagcctctaagctgctcacgttaccggcacgccgtacccccgggactccggggtccctgacgcgtatcgagtggcgaggtcgggtntcggggactagtactttcactctcacatcagcacgcctgacgagcgtagaagtatgtggctagtttattacgtgtaccagtactaataactttccttacttaccgttccgtacggtacgtttccgggcgggacgggaaccgtaagggtggaagacgttaccgaacgttaacgtcggg

SEQ ID NO: 353099 - DNA, 652 bp, Homo sapiens
  misc_feature: GZ8MTXP01EP338.4.33.C11.1.454.CMB.2.raw
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttaattttaaaaggtgtccaatgtgaggtgcagctggtggagtcgtgggggagcttggtccagccgagggccgtccctgagactctcctgtacagcgtctggattcaacttcgtgattangtccttgaactgggtccncaggctcgagggagggctgggagtgggtaggtttcagttagngccagtcggctttagngcgtggggaaacaacaagaaataccggcccgcgttctagggtacgaaaaggcaagtattcatcattactacaaagagatacgaacttaccgaaaccgggctaacgttccggacccttaattccgaggtaccaaggtaaagttacggaaaccgtaacggaccccgtaggaaaacggaccccggaaaggggacccaaaccgacggtacccgttaccttaatttaccgttgggttaggtttaaggggttagtttttacggttagttttttgggttaaggtttaagg

SEQ ID NO: 353100 - DNA, 553 bp, Homo sapiens
  misc_feature: GZ8MTXP01CLWI2.4.33.C11.1.454.CMB.2.raw
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (412)..(412): a, c, t, g, unknown or other
  misc_feature (412)..(412): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtnttatatacagctcaacaatganaactacttagcttggatcagacaagaaaccaggacagaccctactaagctgctacacgtttaccgggcacgccgtacccccggggaacgtccggggtccctggacgcgtattcgagtggcaggcgggtctgggactagtattcactctcacatacancgagcctgacgaggcgtagaagtagtggtggtctagtttattacgtgtcagtctaataatttccttacttaccttccgtacggtacgtttcgggcggacgggaaccgtaagggtggaaggacttacgtaaacgaacgtcgg

SEQ ID NO: 353101 - DNA, 593 bp, Homo sapiens
  misc_feature: GZ8MTXP01EDSNS.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgacaagtccagccagagtgttatatacagctacaaacaatgaagtaactacttagcttaggtatcagacaaagaaaccaggacacgcctactaagctgctacacgtttaccgggcacgccgtaacccccggggacgtccggggtacctggacgacgtattcgaggtcgggcacgggtcgggtcgaggggactagtacttcactctacacatcagcacgcctgacgaggacgtaggaaagtgttaggtcggtacttaagtttattacgtgtacagtactaattaacttcttacttaccttccgtacggtacgtttacggggcggttaacgggtaaccgtaagggtaaggaagtacgttaacgtaaacgttaacgtggg

SEQ ID NO: 353102 - DNA, 516 bp, Homo sapiens
  misc_feature: GZ8MTXP01B0J25.4.33.C11.1.454.CMB.2.raw
  modified_base (386)..(386): a, c, t, g, unknown or other
  misc_feature (386)..(386): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggggcgagagggccaccatcaactgcaagtccagccagagtgttatatacagctccaaacaatgaagaactacttagcttggtatcagcaagaaaccaggacagcctactaagctgctcatttaccgggcagcctacccccggggaatccgggggtccctgacgacgattcgagtggcaggcgggtctggggacngtattcactctcaccatcagcagcctgacaggctagaagatggtgctagtttattacngtcancaattaatcttataccttccgtcgtacttcggcgggaggaaccagggtgagattacgaaacgaatgg

SEQ ID NO: 353103 - DNA, 544 bp, Homo sapiens
  misc_feature: GZ8MTXP01EPXJK.4.33.C11.1.454.CMB.2.raw
  modified_base (357)..(357): a, c, t, g, unknown or other
  misc_feature (357)..(357): n is a, c, g, or t
  modified_base (450)..(450): a, c, t, g, unknown or other
  misc_feature (450)..(450): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggagcttggtccagccagggcgtccctgagactctcctgtacagcgtctggattcaacttcgtgatttatgccatgaaatgggtccgcaggctccgaggggaagggctggagtgggtagttcattagagcatggcttangctagggacaacgagaatacgccgcgtctgtagaaagcagtatcatcatctacaagagatgattaccaacggggcatccgcctatcctgcagntagaacacgccaaggaacgacccggaggacacgacgccgttcttacgttaacgtggttaagtttaggggtagttttagttgtttttgggtaagg

SEQ ID NO: 353104 - DNA, 531 bp, Homo sapiens
  misc_feature: GZ8MTXP01BAW7Y.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtggggcgagagggccaccatcaactgcaagtccagccagagtgttatatacagctccaacaatgagaactacttagcttggtatcagcaagaaaccaggacagcctcctaagctgctcagtttaccggcagctaccccccgggaagtccggggtccctgacgcgattcaggtggcaggcggggtctgggacagattcactctcaccatcagcagcctgcaggctagaagatggtgacgtagtttattacgtgtcagacaataattcttacttacttccgtcgtacgtttcggcgggacgggaaccgaaggtggaaggacttacgtaaacgaacgtaacggg

SEQ ID NO: 353105 - DNA, 664 bp, Homo sapiens
  misc_feature: GZ8MTXP01C3WFK.4.33.C11.1.454.CMB.2.raw
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (346)..(346): a, c, t, g, unknown or other
  misc_feature (346)..(346): n is a, c, g, or t
  modified_base (426)..(426): a, c, t, g, unknown or other
  misc_feature (426)..(426): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctgggtggaggtcgtggggggagcttggtccagccagggcgtccctgagactctcctgtacagcgtctggtattcaactttcgngattangccatgaactgggtccncaggctcgaggggaggctgggagtgggtagttcagttagngcatggcttagtcgcgtagggacaaacgagaaaactacgccggtcgtcgtaggtagaaaggcaagtattacatcatctanaagagatagacttaccgaaacggcaacgtccgtaccttaactcgttacggaccaaggtatacggaaactacggaccctaaggaaaccggacccggaaagggtaaccaacgacggttccccgttactttaaacgtttacgttaggtttgggtttaacggggtttaacgttttttaaacggttaaggtttttttaggggaaggtttacgggttaaacgtttaacgtttttaaaacccccg

SEQ ID NO: 353106 - DNA, 590 bp, Homo sapiens
  misc_feature: GZ8MTXP01D0ZG5.4.33.C11.1.454.CMB.2.raw
  modified_base (332)..(332): a, c, t, g, unknown or other
  misc_feature (332)..(332): n is a, c, g, or t
tcagagcactgtagcacgaccggtgctcgatttagagtgagctcgttggggtttgggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacgggccacatcaactgacaagtccagccagtagtgttatatacagctaccaacatgaataactacttagcttaggtactcagacaaagaaaccaggacacgcctactaagctgctactacgttaccggnacgccgtaacccccggagtccgggcctgacgacgtatcgaggtcgacgaggtcgggtcgagggacagtattcactctacacatcagcagcctgacgaggacgtagaagtatggtaggtacttagtttaacttacgtgtactagactaattaacttacttaacttaccgttccgttacggtaacggtttcgggacgggttaacgggtaaccgtaagggtaacgggaaacgtacgttaacgtaaaccgttaagtaacggg

SEQ ID NO: 353107 - DNA, 543 bp, Homo sapiens
  misc_feature: GZ8MTXP01EKA4L.4.33.C11.1.454.CMB.2.raw
  modified_base (319)..(319): a, c, t, g, unknown or other
  misc_feature (319)..(319): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctacaacaatgagaactacttagcttggtatcagcaagaaaccaggacagcctactaagctgctcagtttaccgggnacgccgtacccccgggatccggggtccctgacgcgattcgaggtggcaggcgggtctggggacagtattcactctcacatcagcagcctgacaggcgtaggaagatggtggactagtttattactgtacagtactaaattaacttcttacctacttccgtcgggtaactttcggggacggttacgggaaccgaagggtggtaggacttacgtaaacgaacgtgg

SEQ ID NO: 353108 - DNA, 555 bp, Homo sapiens
  misc_feature: GZ8MTXP01B2YYM.4.33.C11.1.454.CMB.2.raw
  modified_base (327)..(327): a, c, t, g, unknown or other
  misc_feature (327)..(327): n is a, c, g, or t
  modified_base (383)..(383): a, c, t, g, unknown or other
  misc_feature (383)..(383): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtggggcgagagggccaccatcaactgacaagtccagccagagtgttatatacagcctacaaacaatgaagaactacttagcttggtatcagcaaagaaaccaggacagccctacctaagctgctcattaccgggnacgccgtacccccgggatccggggtcctgagcgattcgagtcggcagggccgggtntagggacagtattcactctacaccatcagcagcctgcacgggctaggaaagatggtggcttaggtttactactgtcagactaattaacttaccgttactaccgttccgttaccggtacgtttcggggcgggacggggaaccgaagggtcggaagattacaaaccggaagtgg

SEQ ID NO: 353109 - DNA, 552 bp, Homo sapiens
  misc_feature: GZ8MTXP01APE6M.4.33.C11.1.454.CMB.2.raw
  modified_base (349)..(349): a, c, t, g, unknown or other
  misc_feature (349)..(349): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaaacaatgagaactacttagcttggtatcagcaagaaaccaggacagcctactaagctgctcagtttaccgggcagccgtacccccgggaagtccggggtcccngagcgtattcgaggtgggcgaggcgggtcgtgggacagtatttcactctcaccatcagcacgcctgcaggcgtagaagtacgtggtggtctaggtttacttacgtgtaccagtcctaaattaacttacttaccttacttccgtcggtcgttcgggcgggttacgggaaccgtaagggtgagacttacgaacgttaacgtaagg

SEQ ID NO: 353110 - DNA, 527 bp, Homo sapiens
  misc_feature: GZ8MTXP01A8FI2.4.33.C11.1.454.CMB.2.raw
  modified_base (388)..(388): a, c, t, g, unknown or other
  misc_feature (388)..(388): n is a, c, g, or t
  modified_base (449)..(449): a, c, t, g, unknown or other
  misc_feature (449)..(449): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttatatacagctccaaacaatgagaactacttagcttggtatcagcaagaaaccaggacagcctaccaagctgctcatttaccggcacgccgtaccccccggggaatccgggggtccctgacgcgattcgagtggcaggcgggtctggggacagtnttcactctcaccatcagcagccctgcagggctagaagagtggtggactagtttattacgtntcagacctaataattcttactacttcgtcggtcttcgggcgacgggaaccaggtgagattacgaaacgaacgtaacgg

SEQ ID NO: 353111 - DNA, 566 bp, Homo sapiens
  misc_feature: GZ8MTXP01EUTB6.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttatatacagctaccaacaatgaagaactacttagcttggtatcagacaagaaaccaggacagcctactaagctgactacagtttaccgggcacggaccgtaacccccggggaacgtccgggggtccctggacgacgattcgagggtggcagggtcgggtcgtaggggacagtacttcactctcacatcagcagccgagacgaggacgtagaagtattcgggtaggtactaagtttatacgtgtcagactaataattacttactacttccgtacgtcgttccggcgggacggtaacggaggtaaggagtacgttacgtaacgttaacgtggg

SEQ ID NO: 353112 - DNA, 652 bp, Homo sapiens
  misc_feature: GZ8MTXP01AX1WL.4.33.C11.1.454.CMB.2.raw
  modified_base (254)..(254): a, c, t, g, unknown or other
  misc_feature (254)..(254): n is a, c, g, or t
  modified_base (337)..(337): a, c, t, g, unknown or other
  misc_feature (337)..(337): n is a, c, g, or t
  modified_base (475)..(475): a, c, t, g, unknown or other
  misc_feature (475)..(475): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagagtgttatatacagctaccaaanaatgaagtaaactacttagcttggtatacagacaagaaaccaggacacgtcctacctaagctcgctacgacgtttacccgggnacggccgtaaccccccggggaattccgggggtcctagacgacgtacgtttcgaagggtcggacgacgggtccggggttcgacggggaacctagttactttaccaccttctaccaacctactcgacggacacggtcccncggacgaacggacggtaaggaaagtcgtaggttacgtacgtttaagtttacttacgtcgtactaagtactaattaacttccttaaccgttaccgttaccgtacgggttacggttacggggacgggaacgggtaaccggtaagggtaacgaacgtaacgttaacgtaaacggttcgtg

SEQ ID NO: 353113 - DNA, 546 bp, Homo sapiens
  misc_feature: GZ8MTXP01ALAWZ.4.33.C11.1.454.CMB.2.raw
  modified_base (291)..(291): a, c, t, g, unknown or other
  misc_feature (291)..(291): n is a, c, g, or t
  modified_base (358)..(358): a, c, t, g, unknown or other
  misc_feature (358)..(358): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaggtgtccaatgtgaggtgcagctggtggagtcgtggggggaggcttggtccagccgaggggcggtccctgagactctcctgtacagcgtctggattcaacttcgtgattangccatgaactgggtccgcaggctcgagggagggctggagtgggtagttcattagagcatggcttagngcgtagggaacaacgagaactacgccgtcgtcgtagtagaaaggcagtattcatcatctacaagagatagacttaccgaacggggcacgtccgacctatctgcagatagaacacgctaagaacgacgagacgacngccgttnttattaacgtgtggttaggttaggtttacgttaagttttggtaagg

SEQ ID NO: 353114 - DNA, 503 bp, Homo sapiens
  misc_feature: GZ8MTXP01ERMJG.4.33.C11.1.454.CMB.2.raw
  modified_base (485)..(485): a, c, t, g, unknown or other
  misc_feature (485)..(485): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtatatacagctcaacaatgagaactacttagcttggtatcagcagaaaccaggacagcctactaagctgctcatttaccggcagctacccccgggatccgggtccctgagcgattcgagtgcagcgggtctgggacagtattcactctcacatcagcagcctgcaggctagagatgtgcagtttatacgtgtcagcaataattcttactacttccgtcggtaacttcgggcggacggaaccgaaggtggaganacaaacgttaagtaacgg

SEQ ID NO: 353115 - DNA, 565 bp, Homo sapiens
  misc_feature: GZ8MTXP01ANA6N.4.33.C11.1.454.CMB.2.raw
  modified_base (442)..(442): a, c, t, g, unknown or other
  misc_feature (442)..(442): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtatatacagctccaaacaatgagaactactagcttggtatcagcaagaaaccaggacagcctactaagctgctcgtagtttaccgggcacgaccgtacccccggggaagtccgggggtccctggacgcgtacttcgacggcgggcgagggccggggtcgtgggacagtactttcactctacaccatcagcagcctgcaggcgtagaagtntgtgtctaggtttactactgtcagtctaataacttacttacttaccttcccgtacgggtccgtttcgggcgggaacgggtaaccgaagggtcggagacgttaacgaaacgttaacgttaaggg

SEQ ID NO: 353116 - DNA, 574 bp, Homo sapiens
  misc_feature: GZ8MTXP01BUSJK.4.33.C11.1.454.CMB.2.raw
  modified_base (546)..(546): a, c, t, g, unknown or other
  misc_feature (546)..(546): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagagggccaccatcaactgcaagtccagccagagtgttatatacagctccaacaatgaagaactacttagcttggtatcagcaaagaaaccaggacacgcctactaagctgctcacgtttaccgggcacggccgtaaccccccggggaagttcccgggggtccctggacgtcgtacttcgaggtcgggcaacgggtcggggttacgtgggggaactaggtactttcactcctacaccaatcaggcacgcctgacaggcgtagaagtgtaggtggctagtttattactgtacagctaattaactcttacctacgttcgtcggtcgtttcgggcgaggggaacctagggngtaagacgttacgtaaacgcgtaacggg

SEQ ID NO: 353117 - DNA, 553 bp, Homo sapiens
  misc_feature: GZ8MTXP01AU555.4.33.C11.1.454.CMB.2.raw
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaaacaatgaagaactacttagcttggtatcagcaagaaaccaggacagcctactaagctgctcgactttaccgggcagccgtaacccccgggactccgggggtccctggacgcgtaattccgaggtcggcagggtcgggtcgtgggacagtatttcactctcacatcagcagccgtgtacggctagggaagtgtagtggctagtttatacgtgtacagacctaaattcttaactaacttacctccgttacggtacgtttcgggcggttaggaccgaagggtgaagactacgaaacgtaacgttgtcg

SEQ ID NO: 353118 - DNA, 584 bp, Homo sapiens
  misc_feature: GZ8MTXP01BQKUC.4.33.C11.1.454.CMB.2.raw
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (390)..(390): a, c, t, g, unknown or other
  misc_feature (390)..(390): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtntanatacagctacaacaatgaagaaactacttagcttggtatcagacaagaaaccaggacagcctacctaagctgctctagtttaccgggcacgcctaacccccgggaacgtccggggtccctggacgaacgacttcgagtcgggcgaggcgggtagngggacagtatttcactctacactatcagcacgcctgacagggctaggaaagagtggtaggtcgttaagtttacttaacgtcgtccagtactaattaacttaccttacttacgttccgtacggttacgtttccgggcgggttacgggaacccgtagggtaacggatacgttacgtaaaacgttaaccggttaagg

SEQ ID NO: 353119 - DNA, 633 bp, Homo sapiens
  misc_feature: GZ8MTXP01A5UD6.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaaacaatgagaactacttagcttggtatcagcaagaaaccaggacacgtcctactaagctcgctactacgttaccggcacgtccgtaccccggacggtccgggtcctgacgcgtacttcgagggtcggacgacgggtcgggtcggtacgggactaggttactttaccgaccttcctaccgaacctacgtacgacgacgacgtccgtacggacgtacggtacgtaaggaaacgtgtcgggtacggtacttaggttttaactacgtgtacacgtactaaattaacttaccttaacgttaccgttcccggttacggttaaccggtttccggggacgggttaacgggaacgtaagggtggaacgtacgttaaccgtaaaacgttcggtgg

SEQ ID NO: 353120 - DNA, 679 bp, Homo sapiens
  misc_feature: GZ8MTXP01C2F4C.4.33.C11.1.454.CMB.2.raw
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
tcagagcactgtagcacgaccggtgctcgatttagagtgagctcgttggggtttgggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtggggggaggcttggtccagccgagggcgtcctgacgactctctgtacagcgtctggtattctactttcgtgtattangccagtcgaacgtcgggtcccncaggctccggagggggagggctggggtaggttgggttaggtttacagtttaggacgtcctagtcggtctttagtcggacgtaggggaactaaacgagaaaacgtacccggccgtcgttacgtagggtaggaaaacgggcaagtacttacatacatctaacgaagagtactagtactaccgaacgcacgtaccgtcttagtctgacgaagtagtacgaactacggacctaggaaacgaccggaaacggaaccaacggacgtcccgttacgttaaacgttacggttggtttacgggtttaaggggtttaacgttttaacggtttaagtttttaggggagtttacggttaactttaactttaaaaccccg

SEQ ID NO: 353121 - DNA, 618 bp, Homo sapiens
  misc_feature: GZ8MTXP01DH12G.4.33.C11.1.454.CMB.2.raw
tcagagcactgtagcacgaccggtgctcgatttagagtgagctcgttggggtttggggggagctacaacaggcaggcaggggcagcaagatggtgttgcagacccaggtcttcatttctctgttgctctggatctctggtgccgtacggggacatcgtgatgacccagtctccagacctccctggctgtgtctcgtggggcgaggacgggccaccatcaactgacaagtccagccagtagtgttaatatacagctaccaaacaatgagaactacttagcttggtatcagcaacgaaaccaggacacgcctacctaagctgctctacgtttaccgggcaggaccgtaacccccgggaacgtccgggggtcctgacgcgtattcgagtcgggcgagggccgggtgtgggacagtattcactctaccaccatcagtcacgccgtacgacgacggtcgttaaggaaggtacgttgggtaggtaccttaggttttaacttacgtggtacagtacctaaattaactttaccttacttaccgttccgttacgggttacgtttcgggggacggttacgggggaaccgaagggttcggacgacgttaacgaaacggttaacgtcggg

SEQ ID NO: 353122 - DNA, 541 bp, Homo sapiens
  misc_feature: GZ8MTXP01AP5GV.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctcaacaatgagaactacttagcttggtatcagcaagaaaccaggacacgcctacctaagctgctcatttaccgggcagccgtaacccccgggaactccgggggtccctgacgacgattcgaggtcggcaggcgggtcgtgggacagtattcactctcacatcagcagcctgcgaggcgtagaagtatggtggctagtttattactgtcagtactaataacttcttactaccttccgtacggtacgttcggcgggacgggtaaccgaggtcggagacgttacgtaacgttaacgtcggg

SEQ ID NO: 353123 - DNA, 601 bp, Homo sapiens
  misc_feature: GZ8MTXP01BD3E4.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagagtgttatatacagcctaccaaacaatgaagaactacttagcttaggtatcagacaaagaaaccaggacacgcctactaagctcgctacgtacgttaccgggcacggtccgtaacccccggggacgtccggggtcctaggacgcgtattcgaggtcgggactacgggtcgggtacgtaggggacagtactttccactctaccaacctacgtacgacgaccgacgtccctggaccgaggcgtaggaaagtgttcggtaggtacttaagttttactacgtgtactaagtactaattaacttcttaacctaccttccgtacggtacgttcgggcggttacggaacgaggtcgagattacgtaacgttaacgtg

SEQ ID NO: 353124 - DNA, 537 bp, Homo sapiens
  misc_feature: GZ8MTXP01D72NH.4.33.C11.1.454.CMB.2.raw
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
  modified_base (326)..(326): a, c, t, g, unknown or other
  misc_feature (326)..(326): n is a, c, g, or t
tcagagcactgtagcacgaccggtgctcgatttagagtgagctcggttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaaccatcaactgacaagtccagccagagtgtanatacagctaccaaanaatgaagaactacttagcttggtatcagacaagaaaccaggacagcctacaagctgctcacgttaccgggnacggccgtaacccccgggacgtccggggtcctgacgcgattcgagtgcaggcgggtctgggacagtattcactctacacatcagcagcctgacaggctagaaagtgtggtggacttaagtttatacgtgtcaagtctaaattcttacttactacgttcgtcgtaacgttcggcggttacggaacgaggtcgagacacgtaacgttaacgtg

SEQ ID NO: 353125 - DNA, 546 bp, Homo sapiens
  misc_feature: GZ8MTXP01EIWUI.4.33.C11.1.454.CMB.2.raw
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (325)..(325): a, c, t, g, unknown or other
  misc_feature (325)..(325): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
tcagagcactgtagcacgaccggtgctcgatttagagtgagctcggttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacggccacatcaactgcaagtccagccagagtnttanatacagctacaacaatganaactacttagcttaggtatcaagcaaagaaaccaggacacgcctactaagctgctcacgtttaccggnacgccgtaacccccggggatccggggtccctgacgaccgattcgagtggcgaggcgggtcgtagggacagtattcactctacacagtcagcanccgngacgagcgtagagtgtgtgtattagtttatactgtacacgtactaattaacttcttactaccttcgtacggttacggttcgggacggacggaacgtaggaagacgacttaacgtaacgttcgtg

SEQ ID NO: 353126 - DNA, 558 bp, Homo sapiens
  misc_feature: GZ8MTXP01DTJI7.4.33.C11.1.454.CMB.2.raw
  modified_base (258)..(258): a, c, t, g, unknown or other
  misc_feature (258)..(258): n is a, c, g, or t
  modified_base (383)..(383): a, c, t, g, unknown or other
  misc_feature (383)..(383): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactcctggctgtgtctgtggggcgagacgggccaccatcaactgacaagtccagccagtagtgttatatacagctacaacatgaanaactactagcttggatcagacaaagaaaccaggacacgccctactaagctgctacgtagttaccggcacgccgtaacccccgggatccgggggtcctgacgcgtattcgagtggcagggcgggtntgggactagtattcactctacacatcagcacgcgtgacgacggcgtaaggaagtgtaggtcggtacttaaggtttacttaactgtacatactaattaacttacttactaccttcgttacgtacgttacgggcggaacgggaacgtaaggtcggaagacttacgaaacgttcgtgg

SEQ ID NO: 353127 - DNA, 559 bp, Homo sapiens
  misc_feature: GZ8MTXP01CHSWI.4.33.C11.1.454.CMB.2.raw
  modified_base (237)..(237): a, c, t, g, unknown or other
  misc_feature (237)..(237): n is a, c, g, or t
  modified_base (448)..(448): a, c, t, g, unknown or other
  misc_feature (448)..(448): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttanatacagctcaacaatgagaactacttagcttggtatcagacaagaaaccaggacagcctactaagctgctcgtacgttaccgggcacggtcccgtaaccccccgggaacgtccgggggtccctggacgcgtatcgaggtggcgaggcgggtcgtggggacagtacttcgactctacacatacgagcagcctgacgaaggtcgtagaaagtntggtcggtacttagtttacttacgtgtacagtactaattcttcttactacttccgtcggtaccgttcgggcggacgggaacaggggtgagacttacgtaaacgaacgttgg

SEQ ID NO: 353128 - DNA, 568 bp, Homo sapiens
  misc_feature: GZ8MTXP01DXLVU.4.33.C11.1.454.CMB.2.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttaatatacagctcaanaatgaanaactacttagcttggtatcagcaaagaaaccaggacacgcctactaagctgctctacgtttaccggcagccgtaacccccgggatccggggtccctgacgacgtattcgagtcgggcgacgggtcgggtcgtaggggacctagtactttcactctacacccatccgagcacgccgtgacgacggcgtaaggaagtagtggtacggcttagtttacttaacgtgtacagtactaattcttcttactaccttcgtacggtacgtttcgggcggacgggaaccgaagggtcgaagattacgtaaacgaagtcgg

SEQ ID NO: 353129 - DNA, 530 bp, Homo sapiens
  misc_feature: GZ8MTXP01ATELN.4.33.C11.1.454.CMB.2.raw
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (347)..(347): a, c, t, g, unknown or other
  misc_feature (347)..(347): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttanatacagctaccaaanaatgagaactacttagcttggtatcagcaagaaaccaggacagcctactaagctgctcagttaccgggcaggcctaccccgggacgtccgggtcccngagcgattcgagtcggcacggtcgggtactgggacagtatttcactctacaccatccagcagcctcgcgagcgtagaagatgtggtcgtagttattactagtctagtactaataatacttactacttccgtcgtcgttcggttcggacggaacgaggaaggagagttacgtaacgaacgtaag

SEQ ID NO: 353130 - DNA, 719 bp, Homo sapiens
  misc_feature: GZ8MTXP01C25KN.4.33.C11.1.454.CMB.2.raw
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggagcttggtccagccagggcgtccctgagactctcctgtacagcgtctggattcaactttcgtgattatgccatgaactgggtcccgccggagtccgacgggagggggacggtggtagggtagggttagggtttacgttagttaagtacggccgtacgttaggtcgttagttaggtccgtacggggtaacgaaacaacgaaacgtaaacccggacccgtccggtacgttacggttagggaaacggacgtacgtagttactatactatactacgaagaagtatagtacttaccgaaccgactactaccgtcccttaacttcgtagtaccgagtaagtacgaacgacgtaaccgtacgtaaacggaaccggaacggaacgaaccaacgttacccggttcttaacgttacgttggttagggttttacggggtttaagttttaacgggttttaagttttaagggttacggtagggttaactttaacttaaccgttttaaaacccccg

SEQ ID NO: 353131 - DNA, 679 bp, Homo sapiens
  misc_feature: GZ8MTXP01AKFI0.4.33.C11.1.454.CMB.2.raw
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttaattttaaaaggtgtccaatgtgaggtgcagctggtggagtcgtgggggagcgttggtccagccgagggccgtccctgagactctcctgtacngcgtctggattcaacttcgngattangcctagtgaacgtgggtcccgcaggctcgagggggagggctggagttgggtagtttcagttagagccagtggcttagtgccgtaagggaaccaacgagaaactaccgccgtgtctggtacgaaagcaggtattcatcaatcctagaagagtataggaacttacccggaaacggggtctaacgttccgtaccccttaatccgttacgaccgaaggtaaacgtaacgaaaccgtaccggtaccgtaaacggaaaccgggaacccgggaaacggaacccgaaccggtaccggttacccgtttacgtttaacgtttaacggttagggtttaacggggttttaaagggggtttacggtttttaacgggtttaaggtttttaaggggtaag

SEQ ID NO: 353132 - DNA, 645 bp, Homo sapiens
  misc_feature: GZ8MTXP01DAH1F.4.33.C11.1.454.CMB.2.raw
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagactccctggctgtgtctgtggggcgaggacgggccaccatcaactgacaagtccagccagagtntatatacagctacaanaatgaacgtaactattagtcttaggtatcagacaaagaaaccaggacacgcctactagctgtctcgtacgtttaccggactacggacccgtaacccccggggacgtcccggggtctggacgacgtacttcgaggtcgggacgagggccggggtcgtagggactagttacttcactctcaccagtcacgccacgccgtggacgaggtcggtaaggaacgtagtaggtacggtacgttaagtttacttacgtcgtacgaacgtactaaactttaactttacccttacgttacccgttaccgttaccgggtacggttttaccgggggcgggttaaacggggtaacccgtaaaggggtaacggtaacgtacgttaaccgtaaacgttaacggttggg

SEQ ID NO: 353133 - DNA, 628 bp, Homo sapiens
  misc_feature: GZ8MTXP01CUIMN.4.33.C11.1.454.CMB.2.raw
  modified_base (284)..(284): a, c, t, g, unknown or other
  misc_feature (284)..(284): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtggggggagcttggtccagccagggccgtcctgagactctcctgtacagcgtctggattcaacttcgngattatgccatgaactgggtcccgcaggctccgagggggaagggctggaggtgggtagttcagttagcgcctagtggtcttagtgcgtagggaacaacgagaaactacggccgacgtcgtaggtacgaaaggcaagtattcatacatctacaaagagtatagtaacttacccgaaacgggggtactaacgttccgacccttaatccgtagacgaaggtactacggaaacacggacccgtaagaaacggacccggaaggaccaaacgacgttacccgttcttaacgtttaacgtggtttaaggtttaagggggttagtttttacgggttaagtttttgggtaagg

SEQ ID NO: 353134 - DNA, 704 bp, Homo sapiens
  misc_feature: GZ8MTXP01DMZUC.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagtagttgttaatactacagcctaccaaactaatgaacgtaaccttacgttagtcgttaggtatcgaagacaaacgaaacccgaggaacaccgtaccctacgtaaggctcgtcctacgtaacggtttacccgggacgtaccgacccggttaacccccccggggaaccggttcccgggggtacccctaggacggtaccctagttcgagggtcggacgacgggtcgggtcgtaggggactagtacttactactcctaccactaactcgacgacgaccgccgtcgacgacggcgtaaggtaagtagttggtagggtacctttaggttttaataaccgttgtaaccgagtaaccttaaagttaacctttccttaaaccgtcccgtttaccgttaccggggtaacgtttccgggggacgggttaaccggtaaagggtacgggtaaggtaacgtaacaaaccggttaaacgaacggtttggg

SEQ ID NO: 353135 - DNA, 591 bp, Homo sapiens
  misc_feature: GZ8MTXP01AXR55.4.33.C11.1.454.CMB.2.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (359)..(359): a, c, t, g, unknown or other
  misc_feature (359)..(359): n is a, c, g, or t
  modified_base (434)..(434): a, c, t, g, unknown or other
  misc_feature (434)..(434): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttggcttagctgggttttcctgttgctatttaaaggtgtccaatgtgaggtgcagctggtggagtcgtgggggagcttggtccagccagggccggtccctgagactctcctgtacngcgtctggattcaacttcgngattatgccatgaactgggtccncaggctcgaggggagggctggagtgggctaggtttcagtagagccccatggcttangactgggaacaaacagaaactaccggccgtcgtctaggtagaaagggcaggtattccattaccattcagaaaganatacgacttaccggaacgggcaagttccgccctaatcccgtgaccaggtacagaacgaacgaacgacgaagaaccgacggaacgaacgacgccgttaccgttaacttacgttaacgttaggttagggttacggtttaacggtttaagtttttaaggg

SEQ ID NO: 353136 - DNA, 570 bp, Homo sapiens
  misc_feature: GZ8MTXP01AS0XV.4.33.C11.1.454.CMB.2.raw
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (349)..(349): a, c, t, g, unknown or other
  misc_feature (349)..(349): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagctgggttttccttgttgctatttaaaggtgtccaatgtgaggtgcagctggtggagtcgtgggggaggcttggtccagccagggcggtccctgagactctcctgtacagcgtctggattcaactttcgtgattangccatgaactgggtccncaggctcgaggggagggctggagtgggtagttcattagagcatggcttancgctgggaacaacgagaaaactaccggccgcgtctggtagaaaggcagtattcatcatctacaagagatgattaccgaacgcagtcgaccgtatctgacagatagaacagccgtagaacgaccggaaggaacctacgacgcccgttctaacttacgttggttggtttaggggtaagttttaggtaagtttttgggaggttaggtaattaacgtttaacccg

SEQ ID NO: 353137 - DNA, 590 bp, Homo sapiens
  misc_feature: GZ8MTXP01BCPSU.4.33.C11.1.454.CMB.2.raw
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
  modified_base (391)..(391): a, c, t, g, unknown or other
  misc_feature (391)..(391): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcgtccctgagactctcctgtacagcgtctggattcaacttcgngattatgccatgaactgggtccnccaggctccgaggggaagggctgggagtggggtaggtttcagttagagccatggcttangctagggacaacgagaaatacgccgngtctgtgaaagcagatacatacatctactaagagatagacttacccgaacggggctaacgtccgtacctaactctcgacgaacgatacggaaacacggaccgtaacggaaacggaccgaacggaaccgactaacgaccgttcttacttaacgttggttaaggtttaggggtagttttacgttaaggtttttggtaaggg

SEQ ID NO: 353138 - DNA, 539 bp, Homo sapiens
  misc_feature: GZ8MTXP01A19Q2.4.33.C11.1.454.CMB.2.raw
  modified_base (458)..(458): a, c, t, g, unknown or other
  misc_feature (458)..(458): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcaagaaaccaggacagcctactaagctgctcatttaccgggcacgcgtacccccgggatccggggtccctgacgacgattcgaggtcgggcgacggcgggtcgtggggacagtactttcactctacacatcagcacgcctgcgaggcgtagaagtatcggtgctagtttattactgtacganactaataacttcttactacttccgtcggtacttcgggcggttacgggaaccgaggtggagacgttacaaacgttaacgtgg

SEQ ID NO: 353139 - DNA, 654 bp, Homo sapiens
  misc_feature: GZ8MTXP01C5LZ2.4.33.C11.1.454.CMB.2.raw
  modified_base (260)..(260): a, c, t, g, unknown or other
  misc_feature (260)..(260): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccagtagtgttatatacagctacaacaatgaanaactattagcttggtatcagacaaagaaaccaggacacgccctactaagctgcctacgtacgtttaccgggcaggtacccgtaaccccccggggaacgtccgggggtccctaggacgtaccgtattccgagggtcgggacgtacgggccggggtcgtaggggaacaggttactttaccaaccgttcctaccaaccctacgttaccacggtaccgacggtcccgtacggaccgtaacgggtccgttaaggaacggtagttgggtacggtacttaggttttactacgtgtactagtactaaattaacttcttaactaccgttcgtacgggttacgtttcggggacgggaacgggtaaccggaaggtcggaagtacttaacgtaaacgaacgttcgg

SEQ ID NO: 353140 - DNA, 580 bp, Homo sapiens
  misc_feature: GZ8MTXP01BIYKD.4.33.C11.1.454.CMB.2.raw
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
  modified_base (392)..(392): a, c, t, g, unknown or other
  misc_feature (392)..(392): n is a, c, g, or t
tcagagcactgtagcacgaccggtgctcgatttagagtgagctcgttgggtttgggcttagctgggttttccttgttgctattttaaaaggtgtccaatgtgaggtgcagctggtggagtctgggggaggcttggtccagccagggcggtccctgagactctcctgtacagcgtctggattcaacttttcgtgattatgccatgaactgggtccnccaggctccgagggaagggctggagtgggtagttcattagagcatggcttangctgggacaacagaatacgccgcgtctgtagaaaggcagattcatcatctacaagagatgacttccaacggcatcccgcctatctgcaagatgaacagcctagaacgaccgagacacagcccgtntattactggttaggttagggttagttttacgtagttttaggagtaggtattaacttaactaaaccccctatttacgactacgtcgggaccacgggacctcggtccgccgtctcctcacgtcccttccgacgaacgggcccttacgttcccggtccttccccgtgcccgccttcgtccgttccgaacgg

SEQ ID NO: 353141 - DNA, 606 bp, Homo sapiens
  misc_feature: GZ8MTXP01DYEDB.4.33.C11.1.454.CMB.2.raw
  modified_base (235)..(235): a, c, t, g, unknown or other
  misc_feature (235)..(235): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtanatacagctacaacaatgaagaactacttagcttggtatcagcaaagaaaccaggacacgccctaccgtaagctgctacgtagtttacccgggcaggccgtaaccccccggggaacgttcccgggggtccctggacgaccgtattcgaagggtcgggaccgacgggccggggttacgtgggggaactacggtatttccactcctacaacctatcacgcacgccctgacacggcgtagaagtagtggtcggacttagtttacttaacgtgtactagtactaataactttcttacttaccttccgtcggtacgtttcgggcgggacgggaaccgtaagggtcggaacgagttaccgtaaacgaacgttaacggg

SEQ ID NO: 353142 - DNA, 595 bp, Homo sapiens
  misc_feature: GZ8MTXP01B1LUT.4.33.C11.1.454.CMB.2.raw
  modified_base (255)..(255): a, c, t, g, unknown or other
  misc_feature (255)..(255): n is a, c, g, or t
  modified_base (536)..(536): a, c, t, g, unknown or other
  misc_feature (536)..(536): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtctcagactccctggctgtgtctcgtgggcgagacgggccaccatcaactgacaagtccagcagtagttgttatatacagctaccaaanaatgaataactacttagcttaggtactcgaagacaaacgaaaccgaggacacgtccctactaagctagctactaacgttaccggcacgtccgtaacccccggggacgtccgggggtcccaggacgacgtacttcgaaggtcggacgtacgggcggggttacgaggggaactagttactttcaacttcaccaacatcgacgcacgccagacgaggcgtaaggaaagtgtaggtggtacttaagtttattaccgtgtacaatactaattaactcttacgtacnccgtacggtcgttcggcggacggtaacgaggtcgaagtacttaacgaaacgttaagtgg

SEQ ID NO: 353143 - DNA, 572 bp, Homo sapiens
  misc_feature: GZ8MTXP01AK48I.4.33.C11.1.454.CMB.2.raw
  modified_base (388)..(388): a, c, t, g, unknown or other
  misc_feature (388)..(388): n is a, c, g, or t
  modified_base (413)..(413): a, c, t, g, unknown or other
  misc_feature (413)..(413): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttatatacagctaccaaacaatgagaactacttagcttggtatcagcaagaaaccaggacacgcctctaagctgctctacgtttaccgggcacgccgtaacccccggggaacgtccgggggtccctggacgcgtattcgagtggcagggcgggtngggacagtattcactctcacatcancacgcctgcgaggacgtagaagtagtggtacggtcttaaggtttacttacgtgtccaagtactaaataacttccttaacctacgttccgtacggtaccgtttcggggacggttacgggaacccgtaagggtcggagacgttactaaacgttaacgtcgg

SEQ ID NO: 353144 - DNA, 623 bp, Homo sapiens
  misc_feature: GZ8MTXP01COVA1.4.33.C11.1.454.CMB.2.raw
  modified_base (385)..(385): a, c, t, g, unknown or other
  misc_feature (385)..(385): n is a, c, g, or t
  modified_base (420)..(420): a, c, t, g, unknown or other
  misc_feature (420)..(420): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagtgttatatacagctacaaacaatgaagaactacttagcttaggtatcaagcaaagaaaccaggacagcctacaagctgctctagttaccggcagccgtaacccccgggagtccggggtcctgacgcgtaattcgagtggacgaggcgggtcgngggacagtattcactctacaccatccagcacgccngacgagcgtaagaagtgtggtacgtacgttaagtttacttacgtcgtacaacgtaacttaaacttaactttaccttaaccttaccgttacccggttaaccgggttaccgtttaccgggggaaccggggttaaacgggtaaaccggtaaaggggtaacggtaaacggtaaccgttaaaaccggtaaaaccggttaacggttcgg

SEQ ID NO: 353145 - DNA, 627 bp, Homo sapiens
  misc_feature: GZ8MTXP01BMQOA.4.33.C11.1.454.CMB.2.raw
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttggcttagctgggttttcctgttgctattttaaaggtgtccaatgtgaggtgcagctggtggagtcgtgggggagcttggtccagccgagggccgtccctgagactctcctgtacagcgtctggattctaacttcgngattancgccagtcgaacgtcgggtcccnccgaggctccgagggggaacggggctgggaggttgggttaggtttacagttagagcctagtggtcttagcgcgtaagggaacaacgagaacgtaccgccgtcgtcgtaggtacggaaaggcaggtattacatctacttactacgaaagagaatagtaacgttacccgaaccggggctaacgtccgaccttactcgtcgacgtacgagtacgaacgacgccgtaagaaacgaccggaacgacgaacgtaacgttccgttcttacgttaacgtaggttggtttaagggttagttttacggttaagtttttaaggtaagg

SEQ ID NO: 353146 - DNA, 529 bp, Homo sapiens
  misc_feature: GZ8MTXP01B0FS5.4.33.C11.1.454.CMB.2.raw
  modified_base (320)..(320): a, c, t, g, unknown or other
  misc_feature (320)..(320): n is a, c, g, or t
  modified_base (409)..(409): a, c, t, g, unknown or other
  misc_feature (409)..(409): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgaagaactacttagcttggtatcagcaagaaaccaggacacgcctactaagctgctcagtttaccggnagcacccccgggatccggggtcctgagcattcgagtggcaggcgggtctgggacagtattcgactctcaccatcagcagcctgcaggcngaagatgtgctagtttatactgtcagtcaattaacttcttacttaccttccgtacggtacgtttcgggcgggacgggaaccgaagggttgggaacgagttacgaaacgttaacgtaaggg

SEQ ID NO: 353147 - DNA, 539 bp, Homo sapiens
  misc_feature: GZ8MTXP01B46HQ.4.33.C11.1.454.CMB.2.raw
  modified_base (281)..(281): a, c, t, g, unknown or other
  misc_feature (281)..(281): n is a, c, g, or t
  modified_base (367)..(367): a, c, t, g, unknown or other
  misc_feature (367)..(367): n is a, c, g, or t
  modified_base (479)..(479): a, c, t, g, unknown or other
  misc_feature (479)..(479): n is a, c, g, or t
tcagagcactgtagcacgaccggtgctcgatttagagtgagctcgttgggtttgggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggagcttggtccagccagggcggtccctgagactctcctgtacagcgtctggattcaactttcgtgattangccatgaactgggtccgccaggctccgaggggaagggctggagtgggtaggtttcatttagagccatggcttatcgctgggacaanagaaatacgccgcgtctgtgaaaggcagattcatcatctcaagagatgattccaacgcatcgctatctgcagatgaacacgcctggaacgaccgaaggaacacgagccgttntatacttgttgtttagggtaagttttacgtaagtttttggaggttggtaattgtttaacc

SEQ ID NO: 353148 - DNA, 592 bp, Homo sapiens
  misc_feature: GZ8MTXP01ASY5R.4.33.C11.1.454.CMB.2.raw
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (465)..(465): a, c, t, g, unknown or other
  misc_feature (465)..(465): n is a, c, g, or t
  modified_base (512)..(512): a, c, t, g, unknown or other
  misc_feature (512)..(512): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggtttttccttgttgcttattttaaaaggtgtccaatgtgaggtgcagctgggtggagtcgtggggggagcttggccagccgagggcggtccctgagactctcctgtacagcgtctggattcaacttttcgngattangccatgaacgtgggtcccnccaggctccgaggggaacgggctgggagttgggtaggtttcaagttaggagccagtggacttatcgcgtgggaacaacagaaaataccgccgcgtctgggtagaaacggtcaagtacttcatcatctacaagagatgattaccgaacggtcagtcncctatctgacagataggaacagccgtagaaacgaccgaggaacacgngtccgttcttagttacttggttaggtttagggttaagtttacgttaagttttggagttagtaagttaacgtttaaccccg

SEQ ID NO: 353149 - DNA, 542 bp, Homo sapiens
  misc_feature: GZ8MTXP01AVAYD.4.33.C11.1.454.CMB.2.raw
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaacaatgagaactacttagcttggtatcagcaagaaaccaggacagcctactaagctgctcgagttaccgggcacgccgtaaccccccggggagtccgggggtcctggacgacgtattcgaggtggcaggcgggtcgngggacagtattcactctcacatcancagctgcaggctagaagtagtggtcggctagtttataccgtgtacagtactaattaacttcttactaccttcgtcggtcgttcgggcggacgggtaacgagggtcgacgagttacgtaaacgttcgtaagg

SEQ ID NO: 353150 - DNA, 718 bp, Homo sapiens
  misc_feature: GZ8MTXP01CHFU4.4.33.C11.1.454.CMB.2.raw
  modified_base (293)..(293): a, c, t, g, unknown or other
  misc_feature (293)..(293): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagcttgggttttccttgttgcttattttaaaggtgtccaatgtgaggtgcagctggtggagtcgtgggggaggcttggtccagccgaggggcggtccctgacgactctcctgtacagcgtctggtattctaacttttcgtgtaattangaccagtacggaaccgttcgggggtccccgcccgagggccgtacccggaaggggggaacgggggtcgtagggggtaggttgggggttagggttttacaagtttaggacgtaccgtagtggtctttagtcggcgtaggggaactaaacgagtaaaacgttaccgccgtacgtcgtaggtaggaaaggtcaacgtattcattcacttactacgaaagtagtacttagtaccctaaccggactactacgtcccttaatcttcggaacacgtaaagtacgaccgaacgaccgtcggaaacggaaccgggaccgaacggaaacctcggttaccgttacccttagttaagttcggttaaggtttagggtttacgttttaaggtttagtttaagggtttgacggtttataaccgttttaaccttaacccccg

SEQ ID NO: 353151 - DNA, 614 bp, Homo sapiens
  misc_feature: GZ8MTXP01CUODH.4.33.C11.1.454.CMB.2.raw
tcagagcactgtagcacgaccggtgctcgatttagagtgagctcgttggggtttggggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatacaactgacaagtccagccagagtgttatatacagctaccaaacaatgaagtaactattagtcttaggtatacagacaaagaaaccgaggaacacgaccctactaagctgctacgtacgtttaccgggacacggaccgtaaccccccggggaacgtccggggtccctaggacgcgtaattcgaggtgggacgagggcgggtcgtagggacagtacttcactctaccacatacgaagcacgcctgacgacggacgtaggaaagtagtcggtaggtacttaaggtttattacgtgtaccgatactaattaacttcttaacgttaccttccgttacggtcgtttacgggcgggttaacgggaaccgaaggtcggtaacgattaaccgtaaacgttaacgtgg

SEQ ID NO: 353152 - DNA, 583 bp, Homo sapiens
  misc_feature: GZ8MTXP01DT9OT.4.33.C11.1.454.CMB.2.raw
  modified_base (377)..(377): a, c, t, g, unknown or other
  misc_feature (377)..(377): n is a, c, g, or t
  modified_base (511)..(511): a, c, t, g, unknown or other
  misc_feature (511)..(511): n is a, c, g, or t
  modified_base (524)..(524): a, c, t, g, unknown or other
  misc_feature (524)..(524): n is a, c, g, or t
tcagagcactgtagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccggccaacatacgccttcctcccgtcccccttcgcagtaacaccaagtacaggaatataacctgtttcccatcgactacgcttcggctcgcttagggcactcacctgccccgattacgtggacacggaacccttggtctccggcgagcgggtctttcaccgtntttactcgttactatcgtcagtcattcgctacttctgactactcagcatcgcctcacagcaacaccttcacaggcttaacacgaaccgtccctacccctaaccaacaacgcaacgtaacgcgtcgctcgcccgnaagcttagggtcnctaacgttcgggtttaccttcccgtttacaacttcctcccgtcattcctgaactaaccg

SEQ ID NO: 353153 - DNA, 613 bp, Homo sapiens
  misc_feature: GZ8MTXP01CBETS.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagttgttatatacagcctaccaaacaatgaacgaactacttagcttggtatcagaccaagaaaccaggacacgccctactaagctgccttctacgttaccgggcacggccgtaacccccggggagtccggggtccctggacgccgtattcgaggtcggcgacgggcggggtcgtaggggactagtactttccactctaccacactcgacgcacgtccgtgaccgaggtcgtaggaacgtagttggtcggtacgttagttttacgtacgtgtacagtcttaaattaacttaccttacttaccgttccgttacgggtacgtttaccggggcggttaacggggaaccgtagggtcggaagacgttaccgtaaacgttaacgtggg

SEQ ID NO: 353154 - DNA, 557 bp, Homo sapiens
  misc_feature: GZ8MTXP01B4JOG.4.33.C11.1.454.CMB.2.raw
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaaacaatgagaactacttagcttggtatcagcaagaaaccaggacagcctactaagctgctcatttaccgggcacgcgtaccccccgggaagtccggggtccctgacgcgattcgagtggcaggcgggtctggggacagtatttcactctcaccatcancagcctgcaggctgaagtntgtgctagtttatacgtgtacagtctaattaacttcttaccttcttcccgtacgggtaaccgttttcgggacgggaacgggtaacccgaagggttgggaacgtacgttaacgtaaaaccggttaagttcggg

SEQ ID NO: 353155 - DNA, 678 bp, Homo sapiens
  misc_feature: GZ8MTXP01EL4KC.4.33.C11.1.454.CMB.2.raw
tcagagcactgtagcacgaccggtgctcgatttagagtgagctcggttggggtttgggggagctacaacaggcaggcaggggcagcaagatggtgttgcagacccaggtcttcatttctctgttgctctggatctctggtgccgtacggggacatcgtgatcgacccagtctccagacctcccgtggctgtgtctcgtggggcgaggacgggcccaccatacaactgacaagtccagccaagtagttgttaataactaacagtacctaaccaaaactaatagaaacgtaaacttacgttagtctttaggtaactacaagacaaacgaaaacccgaggaaccaacgtccccttaaccgtaaaggtcctacgtaccttaccgtaacggtttaccccggggacaacggtaccccggtaaacccccccggggaacggttcccgggggtaccctaggacgtaacgtacttcggaaggtcggcgtacggggtcgggtacgtagggactagtactttacactctacacactacgagccacgtccgtgacgtacggactaggaaagtgttggtaggtactagtttatacgtgtacatactaattcttacttacctaccgttcgtacggtacgttacgggcggaacgggtaacgaggtaaggagaacgttacgaaaccgttaagtcg

SEQ ID NO: 353156 - DNA, 686 bp, Homo sapiens
  misc_feature: GZ8MTXP01DOU41.4.33.C11.1.454.CMB.2.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
tcagagcactgtagcacgaccggtgctcgatttagagtgagctcgttgggtttggggagtgtgaggggacatgagtggtagaaacagtggatatgtgtggcagtgtctgacctttggttgttttttgttgtaggtgtccaatgtgaggtgcagctgggtggagtcgtgggggagcttggtccagccaggggcgtccctgagactctcctgtacagcgtctggattcaacttttcgngattangccatgaactgggtccncaggctcgagggagggctggagtgggtagtttcagttagancagtggctttagngacgtgggaacaacgagaaactccgccgcgttcngtagaaaacggcaagtattcatacatctacaaagacgatacgtaacttacccgaaacggtctaacgttccgacccttaattccgtagaccgtaaggtaatacggaaacacgacccgtaaggaaacggaacccgggagggaaaccaccgtaacgtcccgttacttaacgtttacgttaggtttaggtttaagggttacgtttttaagtaggtttttgggaagttagggtaaatttaaacgtttaaacccttaaacccccgttagtttacgttaaccgttaacgggttccggggaaccgtaaccggggtaacccgttcgggtaacccgttcccggtttccc

SEQ ID NO: 353157 - DNA, 642 bp, Homo sapiens
  misc_feature: GZ8MTXP01BCGFF.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccaagagtgttatatacagctccaacaatgagaactacttagcttggtatcagcaagaaaccaggacagcctacaagctgctcagtttaccgggcacgccgtacccccgggaacgtccgggggtccctggacgcgtaattccgaggtcgggacgagggtccggggtcgtagggggactacggtaactttcaaccttctaccaacccattaccgaacggccaacggccctgacgacgggtacgttaggaaagtacgttacgggtagggtccttaagttttaacgttaaccgttgtaccgtaagtacctaaattaactttaccttaaccgttaaccttcccgttacggtacgttttcggggacgggttacggggaaccgtaagggttcgggaagtacgttacgaaaacgttaacgttggg

SEQ ID NO: 353158 - DNA, 615 bp, Homo sapiens
  misc_feature: GZ8MTXP01DAQMC.4.33.C11.1.454.CMB.2.raw
  modified_base (526)..(526): a, c, t, g, unknown or other
  misc_feature (526)..(526): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtggggcgaggacgggccaccatcaactgacaagtccagccagagtgttatatacagcctacaaacaatgaagaactacttagcttggatcaagcaaagaaaccagacacgccctaccaaagctgacctacgtacgtttaccgggactacgaccgtaaacccccccggggaagtcccgggggtaccctggaacggtaccggtaattccgagggttcgggaccgaaggggtccggggtacgtggggaactagtactttaccactctacaccatcagcacgcctgacgaggcgtaggaagtagtggtaggcttaagtttattacgtgtcagctaattntacttacttacgttccgtacggtacgtttcgggcggaacgggtaaccgaagggtcggaagtacgttaacgtaaaccggaacgtaacggg

SEQ ID NO: 353159 - DNA, 640 bp, Homo sapiens
  misc_feature: GZ8MTXP01BRV0J.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagagtgttatatacagctaccaaacaatgagaactacttagcttggatcagacaagaaaccgaggacagcctacctaagctgctcacgtttaccgggcagccgtacccccggggaacgtccggggtccctgacgacgtattcgagtcggcgacggcgggtcgtagggacagtattcactcacacatcagcagcctgaccgtagggccgttaggaaggtagtagggttcgggtaccgttaagttttaacgttacgttcggtacgtaaacggtactaaacttaactttacccttaaacggttacccttacccgttaccggggttaccttttaccgggggcggggttaacggggtaacccggaaagggggtcggtaaaggacgttaccgtaaaacggttaaccgtttaagggg

SEQ ID NO: 353160 - DNA, 684 bp, Homo sapiens
  misc_feature: GZ8MTXP01A5ETB.4.33.C11.1.454.CMB.2.raw
  modified_base (328)..(328): a, c, t, g, unknown or other
  misc_feature (328)..(328): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatcgacccagtctccagactccctggctgtgtctcgtgggcgagagggccaccatcaactgacaagtccagccaagagtgttatatacagctaccaaacaatgaagaactacttagcttaggtatcagacaagaaaccgaggacacgcctactaagctgctcagttaccggnacgccgtaacccccggggagtccgggggtccctaggacgacgtattcgaggtcgggacagggtccggggtacgtcgggaactacgtactttacgaccttcctaccaccgtatccgacgccgaacgtccgtacgacgagggacggttaaggaaacggtagttgggtacggtaccgttaagttttaacgttaccgttagttacctaacggtaactaaactttaactttacctttaaccttaaccgtttcccggttaccgggttaaccgttttaccgggggaaccgggttaacgggggtaacccggtaaaggggtaagggtaacggtaacgttaacgaaaaccggttaagttaacgggg

SEQ ID NO: 353161 - DNA, 758 bp, Homo sapiens
  misc_feature: GZ8MTXP01AJRZH.4.33.C11.1.454.CMB.2.raw
  modified_base (252)..(252): a, c, t, g, unknown or other
  misc_feature (252)..(252): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccatcaactgacaagtccagccagagtgttatatacagctacaaanatgaagaactattagcttggtatcagcaaagaaaccaggacacgccctacgtaagcttgcctacgtaacgtttacccgggactaacggtaccccgtaaccccccgggggaacgttcccgggggtaccctagggacgtaccgtaacgtttccggaagggttcggggaccgtaacgggggtccggggttacggtacgggggtaaaccgtaggttaacttttccgaaccttcccgttacccaacctaacggtcaacggccgtaacgggtccctaggaccgaacgggtaccgtaaggaaaggtagttcggggtacggtaccttaagggttttacttaccgttaggttaccgtaacgtaaccttaaagtttaacttcctttaaacccgtttaccgttacccggttaaccggggttacccggttttccgggggaaccggggttaacccgggggtaaccgtaaaggggttgggaacgggttaacgttaaccggaaacgttaaccggttaaggg

SEQ ID NO: 353162 - DNA, 631 bp, Homo sapiens
  misc_feature: GZ8MTXP01DMNV0.4.33.C11.1.454.CMB.2.raw
  modified_base (602)..(602): a, c, t, g, unknown or other
  misc_feature (602)..(602): n is a, c, g, or t
tcagagcactgtagcacgaccggtgctcgatttagagtgagctcgttggggtttgggggagctacaacaggcaggcaggggcagcaagatggtgttgcagacccaggtcttcatttctctgttgctctggatctctggtgccgtacggggacatcgttatcgacccagtctccagactccctggctgtgtctcgtgggcgagacggccacatcaactgacaacgtccagccagagtgttatatacagctacaacatgaagaactatagcttggtatcagacaacgaaaccaggacagccctactaagctgctacacgtttaccggcagccgtaacccgggacgtcccgggggtctggacgtacgtaacttcgaagggtcggaccgagggtccggggtcgtacggggactaagttactttccaactccacctaaccagtccgagcgacgcctcgacgtaggcgtaaggggaagtagtggtacggtcttaagtttacgttacgtacgtacgaacgtaccttaaattacttaaccttaaccgttaccttcccgttacggtaccggtttcgggaacgggttacgggaaccggtaaggtacggtaanaacgtaaccgaaacgtaacgttggtaacg

SEQ ID NO: 353163 - DNA, 598 bp, Homo sapiens
  misc_feature: GZ8MTXP01D4B4H.4.33.C11.1.454.CMB.2.raw
  modified_base (254)..(254): a, c, t, g, unknown or other
  misc_feature (254)..(254): n is a, c, g, or t
tcagagcactgtagcacgaccggtgctcgatttagagtgagctcgttggggttgggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacgggccaccatcaactgcaagtccagccagagtgttatatacagctacaaanaatgaagaactacttagcttggatcagcaaagaaaccaggaccagcctactaagctgactctacgttaccgggcacggaccgtaacccccgggacgtccgggggtcctaggacgtaccgtaagtttccgagggtcgggaccgacggggtccggggtcgtaggggaacctaggtactttccactctaccaactatcagcacgcctgacgtgacgtaggaagtgtggtaggacttagtttaatacgtgtcagtataataacttcttactaccgttcgtccgggtacttcggggcggttaacgggaaccgtaaaggtggaactacgttacgtaaacgttaacgtggg

SEQ ID NO: 353164 - DNA, 550 bp, Homo sapiens
  misc_feature: GZ8MTXP01CMJL6.4.33.C11.1.454.CMB.2.raw
  modified_base (238)..(238): a, c, t, g, unknown or other
  misc_feature (238)..(238): n is a, c, g, or t
  modified_base (291)..(291): a, c, t, g, unknown or other
  misc_feature (291)..(291): n is a, c, g, or t
  modified_base (321)..(321): a, c, t, g, unknown or other
  misc_feature (321)..(321): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgcaagtccagccagagtgttanatacagctaccaaacaatgaagaactacttagcttggtatcagcaagaaaccnggacagcctctaagctgctcagttaccggnacgccgtaacccccgggatccggggtcctgacgcgtatcgagtcggcaggcgggtcgtgggacagtattcactctcacatcagcacgcctgcgaggcgtaggaaagtgtggtacggtacttaagtttattaacgtgtacagtactaattaacttacttactaccttccgttacggtcgtttcgggcggttacgggaaccgagggtgagtagttacgaaacgttaacgtg

SEQ ID NO: 353165 - DNA, 555 bp, Homo sapiens
  misc_feature: GZ8MTXP01BYTRY.4.33.C11.1.454.CMB.2.raw
  modified_base (257)..(257): a, c, t, g, unknown or other
  misc_feature (257)..(257): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
  modified_base (455)..(455): a, c, t, g, unknown or other
  misc_feature (455)..(455): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttggcttagctgggtttcctgttgctatttaaaggtgtcaatgtgaggtgcagctggtggagtcgtgggggagcttggtccagccgagggcggtccctgagactctcctgtacngcgtctggattcaacttcgtgattangccatgaactgggtccncaggctccgagggagggctgggagtgggtaggtttcagttagagccagtggcttagngcgtagggacaacgagaaactacggccgcgtctgtagaaggcagatcatcatctacaagagatgattaccgaacggggcatccgcctatcgtgcaagntagaacagccgtaaggaaacgacggacggacgacgacgttccgttcttacgttaactggttaaggttaggggtagttttacggttaagtttttggtaagg

SEQ ID NO: 353166 - DNA, 594 bp, Homo sapiens
  misc_feature: GZ8MTXP01C9YQ2.4.33.C11.1.454.CMB.2.raw
  modified_base (449)..(449): a, c, t, g, unknown or other
  misc_feature (449)..(449): n is a, c, g, or t
  modified_base (458)..(458): a, c, t, g, unknown or other
  misc_feature (458)..(458): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagacctccctggctgtgtctcgtggggcgaggacgggccaccatcaactgacaagtccagccagtagtgttaatatacagctacaacaatgaagaactacttagtcttaggtactcagacaaagaaaccgaggacacgccctactaagctgtctacacgtttaccgggcacggacccgtaacccccggggaacgtcccgggggtcctaggacgtacgtattcgaggtcggacgaggcgggtcgtagggactagtacttcactctacaccatcagcacgcncgagacggngtagaagtagtggtagtactagtttacttacgtgtacagtactaaattaacttacttacgttaccttccgttacggtacgtttacgggcggttacggaacggaaggtggaacgtacgttaacgtaaacgaacgtgg

SEQ ID NO: 353167 - DNA, 611 bp, Homo sapiens
  misc_feature: GZ8MTXP01EY9PH.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctacaacaatgagaactacttagcttggtatcagcaagaaaccaggacagcctactaagctgctcatttaccggcacgccgtaccccgggatccggggtccctgagcgattcgagtggcaggcgggtctggggacagtactttcactctcacatcagcacgcctggacagggcgtaggaaagtgttcgggtggtaccgttaaggttttacttaacgtcggtacctaagtcctaaattaactttaccgttaaccttaacccgttccgttaccgggttaaccgtttccgggggaccggggttaacgggggtaaccggaaggggttaagggaacggtaacgttaacgtaaaaccggttaaaccgttaagggg

SEQ ID NO: 353168 - DNA, 554 bp, Homo sapiens
  misc_feature: GZ8MTXP01BD8TA.4.33.C11.1.454.CMB.2.raw
  modified_base (252)..(252): a, c, t, g, unknown or other
  misc_feature (252)..(252): n is a, c, g, or t
  modified_base (517)..(517): a, c, t, g, unknown or other
  misc_feature (517)..(517): n is a, c, g, or t
  modified_base (536)..(536): a, c, t, g, unknown or other
  misc_feature (536)..(536): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagagggccacatcaactgacaagtccagccagagttgttatatacagctacaaanaatgaagaactacttagcttaggtatcagacaagaaaccaggacagccctactaagctgctcagttaccgggcacggccgtaacccccgggaagtccggggccctgacgcgtattcgagtggcaggcgggtctgggacagtattcactctacactatcagcacgccgtgacgtacgggactaggaagtacgtggtcggattagtttattaacctgtaccgatactaattaacttacttactaccgttccgtacggtctttcgggnggacggaacgtaggtgganagttaccgaagaacgtgg

SEQ ID NO: 353169 - DNA, 702 bp, Homo sapiens
  misc_feature: GZ8MTXP01AJUZJ.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatcgacccagtctccagactccctggctgtgtctcgtgggcgagacgggccaccatacaactgacaagtccagccaagtagttgttatatacagcctacaaacatgaagaactactagtcttaggtactcgaagacaaacgaaaccgaggacacgtcctactaagctacgctacgtaacgtttacccgggcaacggtaccccgtaaccccccgggggaacgttcccgggggtaccctaggaacgtaccgtacgttccgagggtcgggacgacggggtccggggttagacggggtaactacggttactttccaaccttcctaccgaacctagtccaagtccacgccctaggacgtacggcggtaaaggaacgtagtagggtacggtacttaaggtttaacttacgtcgtacgtaactacttaaatttaaccttaccttaaccttacccgttaccgtaccgggttaacgtttccgggggaaccggttaacggggtaacccgtaaaggggtcggaaacgtaacgttaaccgtaaaacgttaacgtcggg

SEQ ID NO: 353170 - DNA, 774 bp, Homo sapiens
  misc_feature: GZ8MTXP01APIRU.4.33.C11.1.454.CMB.2.raw
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (285)..(285): a, c, t, g, unknown or other
  misc_feature (285)..(285): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggtttcctgttgctatttaaagngtcaatgtgaggtncagctggtggagtcgtgggggagcttggtccagccgagggcgtcctgacgactctcctgtacagcgtctggtattctaacttcgagatttangaccagtcgaacgttcgggtcccgaccgaggcctaccggaagggggaaggggtcgtaggggtaggttagggggtttaacggtttcaagtttacggacggtcctaaggttcgggtactttaagtcggtacccgttaagggggaaaccctaacggaaacgtaaacgttacccgggcccggtaccgttacgtagggtaacggaaaaggcgtaaaggtactttacaacttacaacttacccgtaacgaaaggtagtaagtacggttaactttaaccccggaaacgggggtactaaacgttcccggtacccttaactcccgttagaccgaaagttagtaacggaaaccaccggtccgtaaacgggaaacggacccgggaaagggacctaaacggaccggttacccgttacgttaacgtttaaccggttagggttaacgggttttaaacgggggttacgtttttaacggttaagggttttttaaggggtaaacgg

SEQ ID NO: 353171 - DNA, 636 bp, Homo sapiens
  misc_feature: GZ8MTXP01C9JIJ.4.33.C11.1.454.CMB.2.raw
  modified_base (416)..(416): a, c, t, g, unknown or other
  misc_feature (416)..(416): n is a, c, g, or t
tcagagcactgtagcacgaccggtgctcgatttagagtgagctcgttggggttgggggagctacaacaggcaggcaggggcagcaagatggtgttgcagacccaggtcttcatttctctgttgctctggatctctggtgccgtacggggacatcgtgatgacccagtctccagacctcccgtggctgtgtctcgtggggcgaggacgggccaccatcaactgacaagtccagccagtagtgttaatatacagcctaccaaacaatgaacgtaactacttagtcttaggatcagacaaagaaaccaggacacgcctacaagctgctacgtacgtttacccgggcacgtaccgtaaccccccggggaagttcccgggggtcctggacgcgtattcgaggtcgggcgagggcgggtcgnggggaactagtacttccactcctaccaccataccagcacgccgtgacgacggtcgtaaggaagtagtggtcgtacttagtttacttacgtgtacacgtactaaagttaacttacttaaccgttaccttcccggttaccggtaccggtttaccgggcgggttaacggggaaccgtaaaggggtcggaagtaaacgttacgtaaaaccggttcgttaacggg

SEQ ID NO: 353172 - DNA, 904 bp, Homo sapiens
  misc_feature: GZ8MTXP01EQPRN.4.33.C11.1.454.CMB.2.raw
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcgtccctgagactctcctgtacagtcgtctggtattcaactttcgtgatttatcgcctagtcgaacgttcggggtccccgaccgaggtcctacccggaagggggaaggggtcgttaggggaggtttagggggttaggtttttccaagttttaaggacggtccctaagttcggggtccttttaaagtccggaccggtttagggggaaaccctaaaacgaacggtaaaaacgttaaccccgggccccggtcgtttacccggttagggttaaacggggaaaaaacggggtccgtaaagggttaaactttaccgtaaacgtttacccgtaacttaccgtttaaaccgaaaagggtaaacgggtaatttaacgggaaacttttaaccccgaaaaccggggtacctaaaccgttcccggtacccgtttaaacttccgttacgggaccaaggttaaacgtaacgaaaccgtaacggccccttaaagggaaaccggaaccccgggaagggtaaacccaccggttaaacggtccccgtttaacgtttaaacgttttacccggttaaggggttttcgggttttaaacgggggtttaacgttttttaacggggtttaacggtttttttagggggaacggtttaggggttaaaaccttttaacggtttttaaaacccccccg

SEQ ID NO: 353173 - DNA, 599 bp, Homo sapiens
  misc_feature: GZ8MTXP01A1KFG.4.33.C11.1.454.CMB.2.raw
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
tcagagcactgtagcacgaccggtgctcgatttagagtgagctcgttgggtttggggagctctgggagaggagccccagccgtgagattcccaggagtttccacttggtgatcaaagcactgaacacagaccaccaaccatggagtttgggcttagctgggttttccttgttgctattttaaaaggtgtccaatgtgaggtgcagctgggtggagtcgtgggggaggcttgggtccagccgaggggccggtccctgagactctcctgtacagcgtctggattcaaacttcgtgattangccatgaactgggtccncaggctccgaggggaaggggctgggagtgggtagttcaattagagccatggcttangctgggaacaacgagaaactacggccgtcgtctgtacgaaagcaggattcatcatctacaaagagatgaacttacccgaaacgggggcaacgttccgacccttaatcctggaccaaggactagaaacgacgccctaaggaaacggaccgaaagggaccaacggacgttccggttcttattaaccgtggttggtttaagggtaggtttacgttaagtttttgggtaagg

SEQ ID NO: 353174 - DNA, 660 bp, Homo sapiens
  misc_feature: GZ8MTXP01A8E7N.4.33.C11.1.454.CMB.2.raw
  modified_base (259)..(259): a, c, t, g, unknown or other
  misc_feature (259)..(259): n is a, c, g, or t
  modified_base (290)..(290): a, c, t, g, unknown or other
  misc_feature (290)..(290): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggagcttggtccagccgagggcgtccctgagactctcctgtacngtcgtctggattctaacttttcgtgtattancgacctagtcggaacgtcggggtccccgccgaggcctaccggagggggaagggctggggtaggttggggttagtttcaagtttagacgtccagtggtactttagcgtcgtagggaacaaacgagaaactaccggccgtcgtcgtaggtaggaaacggcaagtacttcatcaatctacgaaagtagatcggtaacttacccgaacgctacgtcccgactagtctgactaagagtacgaaccgtacgacccgtaagggaaaccgaccgggaaacggaaccaacgcgtacccgttattacgttacgttgggttagggttagggttaagtttacgttaagttttgggagtttaggtaactttaacgttaacccc

SEQ ID NO: 353175 - DNA, 769 bp, Homo sapiens
  misc_feature: GZ8MTXP01DHCTT.4.33.C11.1.454.CMB.2.raw
  modified_base (293)..(293): a, c, t, g, unknown or other
  misc_feature (293)..(293): n is a, c, g, or t
tcagagcactgtagcacgaccggtgctcgatttagagtgagctcgttggggtttgggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtggggggagcttggtccagccgagggcgtcctgacgactctcctgtacagcgttctggtattcaacttttcgtagaattancgcctaatcggaacgttcggggtcccgccgaaggtcccgtaccggaggggggaagggtctggggtaggttgggggttagtttcaagtttaggacgtccaagttggctttagtcggcgtagggaactaaacgagaaaccttaccgccggtacgttcgtaggtaacggaaaaggtcaaggtactttacaattacccgtaagtaccttaacgaaaagtaaggttaacgttacggtaaccctttacccggaaacccgggtacttaaccgttaccccggtaccgtttaaacgttccgttacggtaccgtaaagtacgtaaacggaaaccgtaacggtacccgtaaggtaaaccggacccgaagggtaaccaacgttaccggtcccggttaatttaacggttacgtttacgggttaggtttaacggggtttaagttttacggttggtttttagggagttacgttaagttaacctttaacccg

SEQ ID NO: 353176 - DNA, 528 bp, Homo sapiens
  misc_feature: GZ8MTXP01CDU9G.4.33.C11.1.454.CMB.2.raw
  modified_base (393)..(393): a, c, t, g, unknown or other
  misc_feature (393)..(393): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttaatatacagctcaacaatgagaactacttagcttggtatcagcagaaaccaggacagcctctaagctgctcgatttaccgggcacgccgtaacccccgggaatccgggggtccctgacgcgattcgagtggcaggcgggtctgggacagatttcactctnacatcagcagcctgcaggctgaagtntcgtggctagttnttacngttcagctaaagttnttacttactacttccgtacggtctttacgggcggacgggtaaccaggtggacgacttacgaaacgttaacgtaagg

SEQ ID NO: 353177 - DNA, 588 bp, Homo sapiens
  misc_feature: GZ8MTXP01C9J0Q.4.33.C11.1.454.CMB.2.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctgtgggcgagacgggccaccatcaactgcaagtccagccagagtgttatatacagctccaaanaatganaactacttagcttggtatcagcaaagaaaccaggacacgcctactaagctgctctagttaccgggcacggccgtaaccccccggggaacgtccgggggtccctggacgaccgtattcgaggtcgggcgaggccggggtatggggacagtactttcactctacaccatcacgcacgccctgcgaggcgtagaagtatggtagcttagtttatactgtacagtctaattcttccttaactaccttccgttacgggtaccttttacggggcgggttaacgggtaaccgtaaaggggtcgggtaaacgtacgttacgaaaacggttaacgttcggg

SEQ ID NO: 353178 - DNA, 650 bp, Homo sapiens
  misc_feature: GZ8MTXP01CMC49.4.33.C11.1.454.CMB.2.raw
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggagcttggtccagccgagggcgtccctgagactctcctgtacngcgtctggtattctaacttttcgngtattangccatgaacgtgggtcccncgaggctccgagggggaagggcgtgggagttggggtagtttcagtttagacgcctagtggtctttagtcgacgtagggaactaaacgaggaaaacttacccggccggtacgttacgtagggtaaggaaacgggtcaagtacttcatcatctacgaagagtactgaacttaccgaacggctaacgtccgtaccttattcgtcggacaaggtactacgaaactcggacctaaggaacggaccggaaggaaccaacgagtcccgttatttaaacgttcgttgggttagtttacggggttaattttggtaagttttgggagttagtaactttaacgtttaacccc

SEQ ID NO: 353179 - DNA, 565 bp, Homo sapiens
  misc_feature: GZ8MTXP01AVYMK.4.33.C11.1.454.CMB.2.raw
  modified_base (258)..(258): a, c, t, g, unknown or other
  misc_feature (258)..(258): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (429)..(429): a, c, t, g, unknown or other
  misc_feature (429)..(429): n is a, c, g, or t
tcagagcactgtagcacgaccggtgctcgatttagagtgagctcgttgggtttggggagtgtgaggggacatgagtggtagaaacagtggatatgtgtggcagtgtctgaccttggttgttttttgtttgtaggtgtccaatgtgaggtgcagctggtggagtcgtggggaggcttggtccagccagggcggtccctgagactctcctgtacagcgtctggattcaacttttcgtgattatgtcatgaactgggtccncaggctcgagggaagggctggagtgggtagttcattagagccatggcttatgctgggacaacagaatacgccgcgtctgagaaagcagatcatcatctnaaganatgattccaaagcatcgctatctgcagatagaacacgcctagaacgaccggaaggacacacgccgtntattacgtggttagttagggttagtttttacgtagtttttgggagtttggtaattagtttaacttaaacccccttacgtttcgacttaacggttcgggggccgtaacggggaacccgttcgggtccgccgttcccg

SEQ ID NO: 353180 - DNA, 557 bp, Homo sapiens
  misc_feature: GZ8MTXP01CCYLU.4.33.C11.1.454.CMB.2.raw
  modified_base (252)..(252): a, c, t, g, unknown or other
  misc_feature (252)..(252): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttaatatacagctaccaanaatgaagaactacttagcttggtatcagcaaagaaaccaggacacgcctacaagctgctcgtaacgtttaccgggcacgcccgtaacccccggggaacgtccgggggtccctggacgcgtaattcgagtcggcgagcgggtctagggactagtattcactctacacatcagcagcctgcaggctagaagatggagctagtttatactgtacatctaataacttcttacttacttccgtacggtacgtttcggggcggacgggtaaccgaagggttcggagacttaccgaaacggttaacgtcggg

SEQ ID NO: 353181 - DNA, 596 bp, Homo sapiens
  misc_feature: GZ8MTXP01AW6DF.4.33.C11.1.454.CMB.2.raw
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccagggcggtccctgagactctcctgtacagcgtctggattcaattcgngattatgccatgaactgggtccnccaggctccgaggggaaggggctgggaatggggtagtttcattagagccagtggcttangctaggggaacaacgagaaataccgcgtgtctgtaggaaagcagattcatcaatctacaaagagatagaacttacccgaaacggggctaacgtccgacctaacttctcgaccgaaggattacgaaacacggccctaaggaaacgaccggaacggaaccacgacgcccggttcttagtttaacgttggttaaggttaggggtagttttacggttaagtttttaagggtaagg

SEQ ID NO: 353182 - DNA, 576 bp, Homo sapiens
  misc_feature: GZ8MTXP01E4WUA.4.33.C11.1.454.CMB.2.raw
  modified_base (281)..(281): a, c, t, g, unknown or other
  misc_feature (281)..(281): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaggtgtccaatgtgaggtgcagctggtggagtcgtgggggagcttggtccagccagggcggtccctgagactctcctgtacagcgtctggattcaacttcgngattatgccatcgaactcgggtccgccgaggctccgaggggaaggggctggagtgggtaggttcattagngcatggcttagngctagggacaacgagaatacgcccgngtctagtagaaaggcagtattcatcatctacaagagatagattaccgaacggggcatccgacctatctgacaagatagaaacgacgaccgtaaggaaacgaccgggaacggaaccgacgaacgccgttacttacttaacgtggtttaaggttaggggttagttttacggttaagttttgggtaaggg

SEQ ID NO: 353183 - DNA, 576 bp, Homo sapiens
  misc_feature: GZ8MTXP01A3A8U.4.33.C11.1.454.CMB.2.raw
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
tcagagcactgtagcacgaccggtgctcgatttagagtgagctcgttgggtttgggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggaggcttggtccagccgagggcggtccctgagactctcctgtacagcgtctggattcaactttcgtgattatgccatgaactgggtccnccgaggctcgagggaggctggagtgggtagttcagttagngcagtggtcttagngcgtagggacaacgagaactccggaccgcgtctggtagaaaggcagtacttcatcatctacaagagatagtacttaccgaacggcacgtccgaccttatccgtgcagatagaacacgaccgtagaacgaccgaaggacacgaacgccgttactacttacgtgttaggttagggttgttttacgtaagttttagggaagttggtattacgttaaccttaaccccgttaag

SEQ ID NO: 353184 - DNA, 825 bp, Homo sapiens
  misc_feature: GZ8MTXP01A3AMS.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttggcttagctgggttttccttgttgctattttaaaggtgtccaatgtgaggtgcagctggtggagtcgtgggggaggcttggtccagccgagggccggtccctgagactctcctgtacagcgtctggattcaacttcgtgtattatgccatcgaactcggggtcccgccgacggctccgaagggggaagggggcgtagggtaggttgggggttacggtttcaagtttaggacgtccgtaagttcggggtactttaagtcggaccgttaaagggggaaccctaaacgtaaacgggtaaaacgttaacccgggccccggtacgggttaccgttacggggttaaggaaaacggggtacccgtaaaggtaacgttttaccgaacgttaccgttaaacgttacccctttaaacgaaaacgggtaaacggtaagtttaacggggtaaaccttttaacccccgggaaaaccggggggtaccttaaaaccggttcccggttaacccctttaaacgtcccgttacgggaacctaaaggtaacgttacggaaaccgtacggaccccgtaaggaaaccggaccgggaacgggaaaccaacggtaacgacccggttacttacgtttaaccggttgggtttaacgggtttaacggggttaggtttttacgggttaaggttttttcgggtaaggg

SEQ ID NO: 353185 - DNA, 657 bp, Homo sapiens
  misc_feature: GZ8MTXP01A82W1.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagtgttatatacagctaccaacaatgaagaactacttagcttggtatcagacaaagaaaccgaggacacgcctacgtaagctcgctcgtaacgtttaccggggcacggaccgtaaccccccggggaacgtccgggggtccctaggacggtacgtaacttccgaagggtcgggacgtacgggtccggggttacgtagggggaacctaggtactttaccaactcctaccaacctagtaccgaagccgaacgcccgtaggaccgtaacggggcgttaaggaaacggtacgttgggtacggtaccgtttaagttttaacgttacgtcgtacgaacgtactaattaacttacttaccgtaccttccgtacggtaccgtttcgggcggacgggtaacgagggtaacgaagacgttaacgaaacgttgtaacgg

SEQ ID NO: 353186 - DNA, 669 bp, Homo sapiens
  misc_feature: GZ8MTXP01CB9GE.4.33.C11.1.454.CMB.2.raw
  modified_base (491)..(491): a, c, t, g, unknown or other
  misc_feature (491)..(491): n is a, c, g, or t
  modified_base (571)..(571): a, c, t, g, unknown or other
  misc_feature (571)..(571): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctgggtggagtcgtgggggagcttggtccagccgagggccgtccctgagactctcctgtacagcgtctggattctaacttcgtgtattatcgccatggaacgtcgggtcccgccgacggcctccggaagggggaagggggcgtggggagggttaggggtaggtttcagtttaggacgcctaagtcgggtactttagtcggtcgtaagggggaacaacgaacggtaaactaccgggcccgcggttacgtggtaacggaaacggcaaggtattacattcaattcctanaaagagtagtacgaacttacccgaacgggggtctaacgttcccgacccttaatcgttacgacgtaagtactacggaaacncgaccgtaaggaaacgaccggaacggaccaacgcgttaccgttcttacgttaacgtggttaaggtttagggttagttttagttaaggttttggtaagg

SEQ ID NO: 353187 - DNA, 622 bp, Homo sapiens
  misc_feature: GZ8MTXP01B8LMP.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtatatacagctaccaacaatgagaactacttagcttggtatcagcaagaaaccaggacacgcctactaagctgctctagtttaccgggcacggccgtaacccccggggaatccgggggtccctggacgacgtattcgaggtcgggcgagggtcggggtcgtaggggactaggtactttccacgtctaccaccatccagtccacgtccctaggccagggcgtaggaaggtagttggtggtacttaggttttattacgttcgtacgagtacctaagttaacttcttacttccgttccgttccggtacgttttccggggcgggttaacggggaacccgtaaggggttaacgggaacggtacgttaaccggaaaacggttaacgttaacgggg

SEQ ID NO: 353188 - DNA, 624 bp, Homo sapiens
  misc_feature: GZ8MTXP01EWOUU.4.33.C11.1.454.CMB.2.raw
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggagcttggtccagccgagggccgtccctgagactctcctgtacagcgtctggtattcaactttcgtgtattangccatgaactgggtccnccaggctccgaggggagggctgggagtgggtagtttcagtttagagcctagtggtcttagtcggcgtaggggaaccaacgagtaaaactacccggccgtcgtcgtggtaggaaaggcaagtattcaatcaatctacaaagagattagacttaccgaacggctatccgccttatcctgacagtagtacgaaacacgcctaaggaaacggacccggaagggaaccacggacgtcccgttattacgttacgttgggttggtttaggggttaagttttacggttaagtttttaggggagttagggtaactttaacgttaaacccc

SEQ ID NO: 353189 - DNA, 662 bp, Homo sapiens
  misc_feature: GZ8MTXP01AJFVH.4.33.C11.1.454.CMB.2.raw
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (462)..(462): a, c, t, g, unknown or other
  misc_feature (462)..(462): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggaggcttggtccagccgagggccggtcctgagactctcctgtacagtcgtctggattcaacttttcgngtattancgcctagtcgaacgtggggtcccgccgagggtcctaccggagggggaacggggctgggggtaggttggggttaggtttcaagtttaggacgcctaagtggtactttgcggcgtaggggaacaaacgagaaaactccggcccgtgtacgtgagaaagcagtatcatcatctanaagagatcgtaacttaccgaacgctacgtccgacccgttatctgacgaagacgtacgaaacgacgtccctaagggaaaccgaccggaacggaaccacgacggtccccgttattaaacgttccgttgggttgtttaacgggggtttaagtttttacgttaaggtttttagggaggtttagtaagtttaactttaaaccccg

SEQ ID NO: 353190 - DNA, 666 bp, Homo sapiens
  misc_feature: GZ8MTXP01B20MN.4.33.C11.1.454.CMB.2.raw
  modified_base (255)..(255): a, c, t, g, unknown or other
  misc_feature (255)..(255): n is a, c, g, or t
  modified_base (489)..(489): a, c, t, g, unknown or other
  misc_feature (489)..(489): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggccaccatcaactgacaagtccagccagagtgttatatacagcctacaaanatgaagaactacttagcttaggtatcagacaaagaaaccaggacacgcctacctaagctcgctacgtacgtttaccgggcacggacccgtaaccccccggggaacgttcccgggggtaccctaggacgtaccgtaacgtttcggaaggtcgggaccgtacggggtcgggggttacgtagggggaacctagttactttccgacctcctaccaaccatcgaacgccgacgtcccgngacgaggacgtaggaagtgtggtgtacgttaagtttactacgtgtactacgtaacttaacttaacttaccttaccgttaccgttccggttaccgggttaccggttacggggaccgggttaacgggtaaccggtaagggtaacggaacgtaacgttaaccgtaaaccggttaacgtgg

SEQ ID NO: 353191 - DNA, 641 bp, Homo sapiens
  misc_feature: GZ8MTXP01A2X3H.4.33.C11.1.454.CMB.2.raw
  modified_base (253)..(253): a, c, t, g, unknown or other
  misc_feature (253)..(253): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagtgttatatacagctaccaanaatgaagaactacttagcttaggtatcagacaagaaaccaggacacgccctactaagctgctcgtacgtttaccgggcacggccgtaacccccggggaacgtccggggtccctaggacgacgtattcgaggtcgggacagggtccgggtcgtaggggactagttacttccacctctacaccaactcgaacgtccacgccgtcggaccgtaagggccgttaaggaaagtagtggttcggtacctttaggtttacttaacgtcgtactagtactaattaacttccttacgtaccgttccgttaacgggtccggtttacggggacgggttaaccgggtaaccggtaaggggtaacggtaacgtacgttaccgtaaaacggttcgttaaggg

SEQ ID NO: 353192 - DNA, 599 bp, Homo sapiens
  misc_feature: GZ8MTXP01EDQUC.4.33.C11.1.454.CMB.2.raw
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggagcttggccagccgagggccgtccctgagactctcctgtacagcgtctggtattcaactttcgtgtattancgcatgaacgtgggtcccncgaggctcgaggggagggctgggagtgggtagtttcagttagngccagtggcttatcgcgtagggaacaacgagaaaactccgccgcgtcgtaggtagaaaggcaagtacttcatcatctacaaagagtatagaacttacccgaacggctactccgtaccgttatctgacagtactacgaacacgtacctagaacgaccgaaggaaccacgacgtccttagtagttacgttggttaggttagggttaagttttagtaagttttgggagttaggtaacttaacgtttaacccg

SEQ ID NO: 353193 - DNA, 551 bp, Homo sapiens
  misc_feature: GZ8MTXP01AD0BY.4.33.C11.1.454.CMB.2.raw
  modified_base (256)..(256): a, c, t, g, unknown or other
  misc_feature (256)..(256): n is a, c, g, or t
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagacgggccaccatcaactgcaacgtccagccagagtgttatatacagctaccaaanaatgagtaactacttagcttggtatcagacaaagaaaccaggacacgcctactaagctgctacgtactttaccgggcaacggccgtaaccccccggggaagtccgggggtccctaggacgacgtattcgagtcggcagggcgggtcgtgggactagtacttcactctcacatcagcagcctgcnggactgaagtntgnggtctaagttattactgtacactacaattaactcttacgtaccttccgtacgtacgttcggcggaggaacgaggtggacgattaccgaagaacgtgg

SEQ ID NO: 353194 - DNA, 797 bp, Homo sapiens
  misc_feature: GZ8MTXP01CNL4V.4.33.C11.1.454.CMB.2.raw
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggagcttggtccagccgagggcgtccctgagactctcctgtacagcgtctggacttcaacttttcgtgtattangacctatgaacgtcgggtcccnccgaggcctccggagggggaaggggctggggtaggttggggttaggtttcaagtttaggacgtcctaagttcgggtactttaagtccggtaccggttagggggaacctaaaacgaaggtaaaaaccgttaccccggcccggtacgttccgtagggtaagggaaaacgggtccaaaggtactttacgtaacttactaacttaccgttaaccgaaaggtaacgtaacgttacgggtaacctttaccccggaaaaccgggtcctaacgttaccccggttaccctttacgttacccgttacgaaccgtaaggtaacgtaaccggaaaaccgaccggtacccgtaaagggaaaccggaacccgggaaggaaacccaacgttacggtacccgtttacgttaacgtttacgttagggtttcgggtttaaggggttaagtttttaacggttaagtttttagggagtttacggttaactttaacgtttaaaccccg

SEQ ID NO: 353195 - DNA, 603 bp, Homo sapiens
  misc_feature: GZ8MTXP01BYGGK.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctccaacaatgagaactcttagcttggtatcagcagaaaccaggacacgcctactagctgctctacgttaccggcacgccgtaaccccgggagtccgggtcctagcgactattcgaggtcggcagggcgggtcgtgggactagtacttcactctacacctatcagtcacgccgtgacgacgggcgtaggaagtgttggtcggtacctttagtttacgttactcggttaccaagtacctaaattcttaccttaccttacccgttccgttacccggttacggtttccgggggacgggggttaaccggggaacccgtaagggttaacgggacgtaacgttaccggaaaacgttaaccgtggggg

SEQ ID NO: 353196 - DNA, 616 bp, Homo sapiens
  misc_feature: GZ8MTXP01DHO5K.4.33.C11.1.454.CMB.2.raw
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctcagactccctggctgtgtctcgtggggcgaggacgggccaaccatcaactgacaagtccagccagtagtgttatatacagctacaanaatganaactatagcttaggtatcagacaaagaaaccaggacacgccctacaagctgctacgtacgtttaccgggacaggacccgtaacccccggggaacgttccggggtaccctggacgccgtattcggagtcgggcgacgggtccggggtctaggggaactagttacttccactcctacaaccactacagaccacgcctagacgaggtcgtaaggaagtagtggtagtacgttagtttactacgtgtactagtactaaagttaacttccttactcccgttccgttacggtaccgtttacgggcgggttaacggtaacccggtaaggtaacggagacgttaacgtaaacgttaacgtggg

SEQ ID NO: 353197 - DNA, 620 bp, Homo sapiens
  misc_feature: GZ8MTXP01COD8E.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgacaagtccagccagagtgttatatacagctaccaaacaatgaagtaactacttagcttaggtatcagacaagaaaccaggacagccctactaagcctgctcgtacgtttaccgggcacggccgtaaccccccgggggaatccgggggtccctggacgtacgtattcgagggtcgggcgtagggcgggtcgtagggactagtactttacgacttcgtacaccatcgagcacgcctgacgaggtcgtaggaaggtgtggtaggtcttaaggtttacttacgtggtaccaagtactaattaactttacaacttaccgttccgttacggtacgtttccggggacgggttacgggaaccggtaagggttcggaacgtacgttaaccgtaaacggttaacgttcggg

SEQ ID NO: 353198 - DNA, 527 bp, Homo sapiens
  misc_feature: GZ8MTXP01ACN6H.4.33.C11.1.454.CMB.2.raw
  modified_base (368)..(368): a, c, t, g, unknown or other
  misc_feature (368)..(368): n is a, c, g, or t
  modified_base (416)..(416): a, c, t, g, unknown or other
  misc_feature (416)..(416): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctacaacatgagaactattagcttggtatcagcaagaaaccaggacagcctacaagctgctcagtttaccggcagcctacccccgggatccggggtcctgagcgattcgagtggcaggcgggtcngggacagtattcactctacaccatcagcacgcctgcgagcgtagaagntggtgctagttatactgtcagtactaattcttcttactacttccgtcgggtactttcggggacggacggggaaccgtaagggtcggagacgttacgaaacgttaagtcggg

SEQ ID NO: 353199 - DNA, 560 bp, Homo sapiens
  misc_feature: GZ8MTXP01ARUG5.4.33.C11.1.454.CMB.2.raw
  modified_base (245)..(245): a, c, t, g, unknown or other
  misc_feature (245)..(245): n is a, c, g, or t
  modified_base (413)..(413): a, c, t, g, unknown or other
  misc_feature (413)..(413): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctagggacatcgtgatgacccagtctccagactcctggctgtgtctcgtgggcgagagggccaccatcaactgcaagtccagcagagtgttatatacagctacaanaatgaagtaactacttagcttaggtatcagacaaagaaaaccaggacacgacctactaagctgctctagttaccggcagccgtaacccccgggacgtccggggtccctagacgacgtaatcgagtggcaggtcgggtgtgggacagtactttcactctcaccatcgancagcctgaccagggctagaagtatcggtgtacttagtttattaccgtgtaccagtactaattaacttccttaacgttaccttccgttaccggtacgtttcgggcggacgggaacctagggtaagaagattaccgaaacgttaagtgg

SEQ ID NO: 353200 - DNA, 673 bp, Homo sapiens
  misc_feature: GZ8MTXP01ACO0J.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaacgtccagccagagttgttatatacagctaccaaacatgaagaactacttagcttaggtatcagacaagaaaccaggacacgcctacaagctgctactagttaccggcagtccgtaacccccgggagtccggggtccctggacgtcgtacttcgaggtcgggactacgggcggggttcaggggacctaggtactttcaccttcgtaccacctatccgaacgcgaacgtccctaggaccgtaacggtccggtaggaaagtgtacgggttacggtaccgttaagtttacgttacgttcgtacgtaacgtacttaaacttaacttaccttaaaccgttacccgttccggttaccgggttaaccggttttccggggacggggttaaaccggggtaacccgtaaggggttaacgggaaacgtaccgttaaccgtaaaccggttaaccggttaacgggg

SEQ ID NO: 353201 - DNA, 583 bp, Homo sapiens
  misc_feature: GZ8MTXP01BY5ZM.4.33.C11.1.454.CMB.2.raw
  modified_base (253)..(253): a, c, t, g, unknown or other
  misc_feature (253)..(253): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgttatatacagctaccaaanaatgaagaactacttagcttggtatcgaagacaaagaaaccaggacagcctactaagctagctcagtttaccgggcacggccgtaacccccggggaactccgggggtccctaggacgacgtattccgaggtggcaggtcgggtctaggggactagtactttcactctcaccatcacgcacgcctgacgacggcgtaaggaagtagtgtaggtacttaggtttaattactgtcaagtctaaattaacttcttaactccttccgtacgggtaccgtttcggggcggaacgggaaccggtaagggtggaaggacttaacgaaacgaacgttgg

SEQ ID NO: 353202 - DNA, 606 bp, Homo sapiens
  misc_feature: GZ8MTXP01BP3MX.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaaactgacaagtccagccagagtgtatatacagctacaaacaatgaagaactacttagcttaggatcagacaaagaaaccgaggacacgcctacgaagctcgctactagtttaccggcacggtccgtaacccccgggacgtccgggtccctagacgaactattcgaggtcggcgagggtcgggtcgtgggactagtactttcactctacaccgatcacgcacgcctgacaggctagaagtatggtacgacttagtttacttaacgtcgtacgtacgtactaaatttaacttccttaacttaccgttccgttacgggtacgtttacccggggcgggttaaacgggtaacccgtaaggggtggaaacgtacttaacgtaaaccgttaagttcggg

SEQ ID NO: 353203 - DNA, 629 bp, Homo sapiens
  misc_feature: GZ8MTXP01BBMI7.4.33.C11.1.454.CMB.2.raw
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (476)..(476): a, c, t, g, unknown or other
  misc_feature (476)..(476): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgctattttaaaggtgtcaatgtgaggtgcagctggtggagtcgtgggggagcttggtccagccgagggccgtccctgacgactctcctgtacagcgtctggtattctaacttcgngtattangccatgaacgtcgggtcccgcgaggctccgagggggaagggcgtgggaggttggggttaggtttacagttagacgcctagtcgggtacttagtcgtcgtaaggggaaaccaacgagtaaacgtacccggccgtcgttacgtaggtaaggaaaggctaaggtattacatctactctacgaaganagtagtacttaccgaacggggctacgtccgtacctatctgacagatacgaacgacgacctaaggaaacgaccggaacgaccgaacgacgttccgttcttacgttaacgtggttaaggttaggggttagttttacggttaagttttgggtaagg

SEQ ID NO: 353204 - DNA, 636 bp, Homo sapiens
  misc_feature: GZ8MTXP01DNBJP.4.33.C11.1.454.CMB.2.raw
  modified_base (299)..(299): a, c, t, g, unknown or other
  misc_feature (299)..(299): n is a, c, g, or t
  modified_base (392)..(392): a, c, t, g, unknown or other
  misc_feature (392)..(392): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgttctggatctctggtgccgtacggggacatcgtgatgacccagtctccagacctccctggctgtgtctcgtgggcgaggacggccaccatcaaactgacaacgtccagccaagagtgttaatatacagcctaccaaacaatgaagaactactagcttaggtatcagacaagaaaccnggacagccctactaagctgcctactacgttaccgggcacggccgtaaccccggggtaacgtccccgggggtacctggacgcgtaaactttcgngggtcgggacgaacgggtccggggtcgtaggggacctaggtaactttcaaccttcaccacaatcgacgcacggctcgacgacggtacaggggtaaacgtagttggtacggtattaaggtttacttactaggtctaagtacctaaattcttaactacttccgttccgttacgggttacgttcggggaccgggacggggttaaccgtaagggtacggaagtaactacgaaaacgtgttggtaacgg

SEQ ID NO: 353205 - DNA, 697 bp, Homo sapiens
  misc_feature: GZ8MTXP01CES0S.4.33.C11.1.454.CMB.2.raw
  modified_base (259)..(259): a, c, t, g, unknown or other
  misc_feature (259)..(259): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatcgaccagtctccagacctccctggctgtgtctcgtgggcgaggacgggccaaccatcaactgacaagtccagcagtagttgttaatatacagctaccaaanaatgaagtaactacttagtcgttaggtactcgagacaaagaaaccgacggaccgtcctaccgtaaagctacgacttacgtacgtttacccgggcaacggtacccggtaacccggggtaaccgttccccgggggtcctaggacgtccgtaacgttacgaagggtcggaccggtagggtccggggtacgtacggggaactaagttactttccactactaccaaccagtacaacgctacgccgtgacgtacgcgtagggaagtgtggtgggtaccttaaggttacttacgtacgtacgtatacctaaattccttaaccttaaccttaccggttacccggtttacgggtaaccggtttacggggaaccgggttaccggggttaaaccgtaaggggtaggtaaaccgtaactaaccggaaacgtaaccggttggtaacccggg

SEQ ID NO: 353206 - DNA, 777 bp, Homo sapiens
  misc_feature: GZ8MTXP01DE7KP.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagtagtgttaatatacagctaccaaacaatgaagaactacttagcttaggtatcagacaaagaaaaccaggacacgaccctactaagctcgacctaccgtaacgtttacccggggactacggaccccgttaaaccccccccgggggtaaacgttccccggggggtacccctaggaaccggtaaccggtaacgtttccggaaagggttcggggacccgaaggggtcccggggtacgtagggggaaccctaaggttactttaccacttacctaccaacccacgttaccgaacgccaacggcccgttaggaccgtaacggtacggtaaggtaaaggtaacgtgggttacggtaccgttaaagttttaacgttaacgttacgtaccgtaaggtaaccttaaacgtttaactttaaccttaacccgtttaacccgttacccggtttaccggggttaacccggttttaccggggaccggggttaacggggtaaacccggtaaaggggttaacggaacgtaacgttaaccgtaaaaccggttaacgttaacggg

SEQ ID NO: 353207 - DNA, 593 bp, Homo sapiens
  misc_feature: GZ8MTXP01AGD44.4.33.C11.1.454.CMB.2.raw
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctgtgggcgagacgggccaccatcaactgacaacgtccagccagtagtgttanatacagctacaaanangaanaactacttagcttaggatcagacaagaaacccaggacagcctactaagctgctcagtttaccgggcagccgtaaccccgggacgtccggggtccctgacgacgtattcgaggtcggcagggtcgggtcgagggacagtaacttcgactctccaactacgcaacgcacgcctagccagggctaaggaagtagtcggtaggtcctaagtttacgtacgtcgtatacgtaacctaattaactacttaccgttaccgttccgtaccggggtacgtttccggggacgggacgggtaaccgagggtaacgaagtacgttacgaaaaccgttgtaacggg

SEQ ID NO: 353208 - DNA, 551 bp, Homo sapiens
  misc_feature: GZ8MTXP01AOGAL.4.33.C11.1.454.CMB.2.raw
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttggcttagctgggtttcctgttgctatttaaaggtgtcaatgtgaggtgcagctggtggagtcgtgggggagcttggtccagccgagggccgtccctgagactctcctgtacagcgtctggattcaacttcgtgattatgccatgaactggtccgcaggctcgagggagggctggagtgggtagttcattagnccagtggcttagngcgtagggacaacgagaaactacgccgcgtctggtagaaaggcaagattcatcatctacaagagatagacttacccgaacggggctaagtccgacctatcctgacagatacgaacacgccgtaagaacggacgacggaccacgacgccgttcttacttaacgtgtaaggttagggttagttttaggtaagttttggtaagg

SEQ ID NO: 353209 - DNA, 708 bp, Homo sapiens
  misc_feature: GZ8MTXP01CPSMI.4.33.C11.1.454.CMB.2.raw
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
tcagagcactgtagcacgaccggtgctcgatttagagtgagctcgttggggtttgggggagctacaacaggcaggcaggggcagcaagatggtgttgcagacccaggtcttcatttctctgttgctctggatctctggtgccgtacggggacatcgtgatcgacccagtcctccagacctcccgtggctgtcgtctcgtgggcgaggacgggccaaccatacaactgacaagtccagccagtagtnttatatacagcctaccaanaatagaagtaacttacttagcttaggtactcgaagacaaagaaaccaggacacgtaccctacgtaagtcctagtacctacgtaccgtttacccgggactacggtacccggtaaccccccggggacggttcccgggggtcctaggacgtacgtagtcgagggtcggcgaggtcgggtcgtacgggaactagttacttaccactcctaccacctataccgaacgccgacgtccgtaggaccgagggtactaggaaaggttgttacggtacggttaacttacgttttaagtacgtcgtacaacggttactaaactttaaccgttaaaccgtttccttaacccgttcccggttaaccggttaccgggtttacggggccgggttaaacggggtaacccgtaagggggtaacgaaggtaaccgttaacggtaaaaccggttcgttcggg

SEQ ID NO: 353210 - DNA, 637 bp, Homo sapiens
  misc_feature: GZ8MTXP01AEMX1.4.33.C11.1.454.CMB.2.raw
  modified_base (265)..(265): a, c, t, g, unknown or other
  misc_feature (265)..(265): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggagcttggtccagccgagggcgtccctgagactctcctgtacngcgtctggattctaacttcgtgattatgccagtgaacgtgggtcccgccgaggcctaccggagggggaacgggggcgtgggaggttgggggttaggtttcaagttaggacgccagtggctttagtcgcgtaagggaaccaagagaaacgtacgccgcgttcgtagtagaaggcagattcatcatctagaaagagatgacttaccgaaacggggctaacgtccgacctatccgtagctaaggactagaaacgacgcccgtaaggaaaccggaccggaacggaaccaacggtacgttccccgttactttagtttaaccgttaggtttgggtttaacggggttagtttttacggttaaggttttttgggtaaggg

SEQ ID NO: 353211 - DNA, 571 bp, Homo sapiens
  misc_feature: GZ8MTXP01EZR6W.4.33.C11.1.454.CMB.2.raw
  modified_base (395)..(395): a, c, t, g, unknown or other
  misc_feature (395)..(395): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttatatacagctacaacaatgaagaactacttagcttggtatcagacaagaaaccaggacagcctactaagctgctcgtagtttaccgggcacggtccgtaacccccggggacgtccgggggtccctggacgcgtattcgaggtgggcagggtcggggtcngggacagtacttcactctcaccatcgacgcagcctgcgacggcgtaggaagtagtgtagggtcttaggtttatacgtgtaccagtactaatcttacttacgtacttccgtacggtacgttcgggcggttagggaaccgtaggtaacggacgagttacgtaaacgttaacgtaacgg

SEQ ID NO: 353212 - DNA, 726 bp, Homo sapiens
  misc_feature: GZ8MTXP01BLNRW.4.33.C11.1.454.CMB.2.raw
  modified_base (290)..(290): a, c, t, g, unknown or other
  misc_feature (290)..(290): n is a, c, g, or t
  modified_base (315)..(315): a, c, t, g, unknown or other
  misc_feature (315)..(315): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggagcttggtccagccgagggcgtccctgagacctctcctgtacagtcgtctggtattctaactttcgtgattancgccagttcgaacgtcggggtcccnccgaggcctaccggagggggaacgggctgggaggttggggttaggtttcaagtttagacgtcctagtcggactttagcggactaggggaaccaaagacggaaaacttacccggccggtcgttacgtagggtaagggaaaaggtccgaaagtacttacctaattaccctaattacccgttaaacgaaaggttaaacgtaagttacggtaaaccgtttaaccccgaaacgggtcctaaacgttcccgtacgtttactacgttacgacgtaagacgtaacgaaacaacggccgtaaggaaacgaccggaacggtaacaacgttacggtcccttacttaacgttacttgggttaggtttagggttaagttttacgttaagttttggagttaggtaacgtttaacgttaaaccccg

SEQ ID NO: 353213 - DNA, 659 bp, Homo sapiens
  misc_feature: GZ8MTXP01A9WHY.4.33.C11.1.454.CMB.2.raw
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (251)..(252): a, c, t, g, unknown or other
  misc_feature (251)..(252): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagatgttanatacagctccaaanannanaactatantgancagacaagaaacagacacgcctactaagctgactacgtaacgttaccggacacgaccgtaaccccccgggtaacgtccggggtacctaggacgacgtaattcgaggtcggacgtacgggtcgggtcgtacggggaactagtactttaccacgtactaccaacctactacacgacgacgaccgtacgacgacggacggtacgtaaaggtaagtaggtacggtacgttaacgtttaacgtttaacgttacgtacgtaacgtaactaaacttaaactttaaccttaaccttaaccgttacccgttaccggttaccgttacgggttacggggttaccgggtaaccgggtaacgggtaacgggtaacggtaacgttaacgtaaacgttaaacgtaacg

SEQ ID NO: 353214 - DNA, 768 bp, Homo sapiens
  misc_feature: GZ8MTXP01CB9S4.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaaccatacaactgacaagtccagccagagtgtatatacagctaccaaacaatgaaacgtaaactacttagctttagggtactacgaagacaaacgaaaacccaggaaccacgtaccccttacctaaacgcttagtacctaccgtaacggtttaacccgggggcaccgggtacccggttaaacccccccccgggggaacggttccccggggggttacccctagggaacggtaacccggttaacgtttcgggaacgggtttcggggccggaacggggtcccgggggtttacgtaggggggtaacccttaaggttaacttttcccaaccgtttccctaccaacccgtattaccgaaacggtccgaaccggtccccgttaggaccgtaacgggtaccggttaaggaaaggtaccgttacgggttaggggtaaccttaacggttttaatttaacgtcggtacctaagtactaaattaacctttacgttacctaccgttcgtacggttcgttacgggttcggaacgggtaacagggtaaggactacgttacgtaaacgttcgtcgg

SEQ ID NO: 353215 - DNA, 696 bp, Homo sapiens
  misc_feature: GZ8MTXP01C9L03.4.33.C11.1.454.CMB.2.raw
  modified_base (505)..(505): a, c, t, g, unknown or other
  misc_feature (505)..(505): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagcttgggttttccttgttgtcttaattttaaaaggtgtccaatgtgaggtgcagctgggtggagtcgtgggggagcgttggtccagcccgaggggccggtccctgagacctctcctgtacagcgtctggattctaacttcgtgtattatcgacctagtcggaaacgttcggggtaccccgccgaggcctacccggaagggggaacgggggctgggggaggtttgggggtaggtttcaagtttaggacgtcctaagtcgggtactttagtcggtaccgtaaggggaaacctaacgaagtaaacgtaccggccggtcgtcgtaggagtaaaggctaagtattcatcaattcctanaaagacgtatgtaacttacccgaaggggtcctacgtccgtacctaatccgtaggacaaggtactacgggaaaccacggaacccgtaaggaaaccgaccggtaaacggactaaccgtcgttacccgttattaacgtttaacgtaggttaacgggtttaaggggttagtttttacggttgttttaaggtaagg

SEQ ID NO: 353216 - DNA, 677 bp, Homo sapiens
  misc_feature: GZ8MTXP01AS3XW.4.33.C11.1.454.CMB.2.raw
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggagcttggtccagccgagggcgtccctgagactctcctgtacagcgtctggattcaactttcgngattangccatcgaacgtcgggtcccgccgaggcctaccggagggggaacggggctagggaggttgggggtaggtttcagtttaggacgccagtggacttagtcggcgtaggggaacaaacgagaaaacgtaccgcccgtcgtcgtaggtaggaaaggcaagtacttcatcaatctacgaagagtagtacgaacttaccgaaacggctacgttaccgacccttaatccgtagaccgaaaggtactaacggaaacgtacggcccgtaaggaaacggacccggaagggaacccaacgacgggtacccttacttaaagtttacgttgggttaggtttaggggtttaatttttacgggttaagtttttgggagttagggtaacttttaacgtttaaacccc

SEQ ID NO: 353217 - DNA, 577 bp, Homo sapiens
  misc_feature: GZ8MTXP01CVBR4.4.33.C11.1.454.CMB.2.raw
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
  modified_base (287)..(287): a, c, t, g, unknown or other
  misc_feature (287)..(287): n is a, c, g, or t
  modified_base (449)..(449): a, c, t, g, unknown or other
  misc_feature (449)..(449): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacgggccaaccatacaactgacaacgtccagccaagtagtgttatanacagcctacaaacatgaanaactactgtacttaggtancaagacaaagaaaccaggacacgccctacaagctgctacgtagttaccggacacggtaccgtaacccccggggacgtccggggtcccagacgacgtacgtcgaggtcggacggtacgggcgggtactcgggactatactttcacttcacacagtcagccacncgcgacgagaggtagagtagtagtagtagttagttattagtacgtacatactataactacttactacgttcgtacggtcgttacggcggacgggtaacggaggtaacggagacgacgtaacgaacgtg

SEQ ID NO: 353218 - DNA, 522 bp, Homo sapiens
  misc_feature: GZ8MTXP01BQYI5.4.33.C11.1.454.CMB.2.raw
  modified_base (387)..(387): a, c, t, g, unknown or other
  misc_feature (387)..(387): n is a, c, g, or t
tcagagcactgtagcacgaccggtgctcgatttagagtgagctcgttgggttggggagctacaacaggcaggcagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctctaagctgctcattaccggcagctacccccgggatccggggtccctgagcgattcgagtggcagcgggtctgggacagattcactctcacatcgancagcctgcaggctagagagtgtggtctagtttacttacgtcgtcagtccaaattaattccttaactaccttccgtcggtaacgtttcggcgggaacgggtaaccgaagggtggacgagttacaaacgaacgtggg

SEQ ID NO: 353219 - DNA, 769 bp, Homo sapiens
  misc_feature: GZ8MTXP01BASXA.4.33.C11.1.454.CMB.2.raw
tcagagcactgtagcacgaccggtgctcgatttagagtgagctcgttggggtttgggggagctacaacaggcaggcaggggcagcaagatggtgttgcagacccaggtcttcatttctctgttgctctggatctctggtgccgtacggggacatcgtgatcgacccagtcctccagacctccctggctgtgtctcgtgggcgaggacgggccaccatcaactgacaagtccagccagtagttgttaatatacagacctaccaaactaatagaacgtaaaccttacgttagcgttaggtactaccgaagaccaaagaaacccgaggaccacgtacccctaacgtaacgcgtcgtacctacgtaaccggtttacccgggacctaacggtccccggtaaacccccccgggggaacggttcccgggggtaccctagggaccggtaaccgttaacgttccgaaggggtccgggacgtacggggtccggggttacgaacgggggtaacctacgtactttaccgaccttaccgtacccaacctacgaccacggaccgaaccgggtccctaggaccgtaagggtccgtaaaggtaaacggtcgttagggttacgggtaccttttaaggtttacttaaccggttgtacccgtaagtacttaaacttcctttaaccttaccgttacccggttccgttaccgggttaacgggtttccgggacggggaacgggtaaccgtaggggtaaggtaactaacgttaaccgaacggttaacgtggg

SEQ ID NO: 353220 - DNA, 718 bp, Homo sapiens
  misc_feature: GZ8MTXP01C8XWL.4.33.C11.1.454.CMB.2.raw
  modified_base (348)..(348): a, c, t, g, unknown or other
  misc_feature (348)..(348): n is a, c, g, or t
tcagagcactgtagcacgaccggtgctcgatttagagtgagctcgttggggtttggggggagctacaacaggcaggcagggggcagcaagatggtgttgcagacccaggtcttcatttctctgttgctctggatctctggtgcctacggggacatcgtgatgacccagtctccagactccctggctgtgtctcgtggggcgaggacgggccaccatacaactgacaagtccagccagtagtgttaatatacagcttacaaacaatgaagaactacgttagcttaggtatcgaagacaaagaaaccgagacacgtaccctactaagctagctactagtttacccggganacggccgtaaccccccggggacgtccgggggtaccctggacgaccgtattcgagggtcgggacgtacgggcggggtacgtcggggaacgtagtactttaccacgttacctaccaacctactaccgacgccgaaccggtcccgtgaccgtaacgggtacggtaaggtaaaggaagttcgggttacggtaccgttaaggttttaacttaaaccgttgtaaccgtaacgtaacttaaacttaactttaaccttaaccgttaccgttacccgttacgggttaaccggtttacggggaccggggttaaacggggtaacccggtaaaggggtccgggtaaagtaacgttaaccgtaaaacggaacggttaaccggg

SEQ ID NO: 353221 - DNA, 622 bp, Homo sapiens
  misc_feature: GZ8MTXP01COGDK.4.33.C11.1.454.CMB.2.raw
  modified_base (322)..(322): a, c, t, g, unknown or other
  misc_feature (322)..(322): n is a, c, g, or t
  modified_base (366)..(366): a, c, t, g, unknown or other
  misc_feature (366)..(366): n is a, c, g, or t
  modified_base (429)..(429): a, c, t, g, unknown or other
  misc_feature (429)..(429): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcatgatcgaccagtctccagacctcctggctgtgtctcgtgggcgagaggccaccatcaactgacaacgtccagccagagttgttatatacagctacaaacagagaacgaacttacgttagtacgttaggtactacagacaaacgaaaccgaggaccacgcctactaanctgctactacgttacggcacgtccccgtaccggacgtccggtcngaacgctgtcgaggtcggcgagggcgggtacgtcgggactagtactttcactccgtacaactntacacgtacacgtccgtgacgacgggggtctaaggaacgtgtacggtcgacgtttaagtttacgttagtcgtaacctataacctaatttcgttacctaacgttccgttaccgtcgggttaccgtttcgggggacccggtaaggggaacccgttaaggggtcgtaaacgttactaacgttaaacggttaaccgg

SEQ ID NO: 353222 - DNA, 693 bp, Homo sapiens
  misc_feature: GZ8MTXP01ASVJT.4.33.C11.1.454.CMB.2.raw
  modified_base (280)..(280): a, c, t, g, unknown or other
  misc_feature (280)..(280): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggagcttggtccagccgagggcgtcctgagactctctgtacagcgtctggattcaacttcgngtattatcgcctatacggaacctggggtccccgccgaggcctcccgaaggggggaacggggtccgtaggggaggttgggggttaggtttaccgagtttaacggagccgtaagtcgggtactttagtcggccgtaaggggaaccaacgagaaactaccgggccgacgtctggtagaaacggtcaagtaacttcatctatctacaagagagtacgtacttacccgaacggggtaccagtcccgacctaactcgttcggactaaggaattacgaaaccgacgtacccggtaaggaaaccggacccgggaacggaaccgtaaaccgcggttaacccccggttattaccctttaaggtacgtttaacggggtttaagggttacgggtttttaggttaacgttttttaagggtaagggg

SEQ ID NO: 353223 - DNA, 597 bp, Homo sapiens
  misc_feature: GZ8MTXP01DQN96.4.33.C11.1.454.CMB.2.raw
  modified_base (458)..(458): a, c, t, g, unknown or other
  misc_feature (458)..(458): n is a, c, g, or t
  modified_base (498)..(498): a, c, t, g, unknown or other
  misc_feature (498)..(498): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtctccagactcccgtggctgtgtctcgtgggcgaggacgggccaccatcaactgacaagtccagccaagtagtgttaatactacagctacaacaatgaagaactacttagcttggtatcgaagacaaacgaaacgagacacgcctaccgtaagctcgtactcgtaacgtttaccgggacacggtaccccgtaaccccggggaacgtccggggtccctaggacgtacgtattcgaggtcgggacagggtcggtgtgggactagtattacgactctacacatcagcacgtccgngacgacgagtaagtagtgtgtagtattagtttactacgtntactatactaattcttacttaccttacgttcgtacggttacggttacgggcggaacggtaacgtagggtaacgaataacgttaacgtaacggttcgtgg

SEQ ID NO: 353224 - DNA, 620 bp, Homo sapiens
  misc_feature: GZ8MTXP01DHW3C.4.33.C11.1.454.CMB.2.raw
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
tcagagcactgtagcacgaccggtgctcgatttagagtgagctcggttgggtttgggggagctacaacaggcaggcaggggcagcaagatggtgttgcagacccaggtcttcatttctctgttgctctggatctctggtgcctacgggacatcgtgatgacccagtctccagactccctggctgtgtctcgtgggcgagacgggccaccatcaactgacaagtccagccagagtnttanatacagctacaaanaatgaagaactacttagcttaggatcaagcaaagaaaccaggacacgccctacgtaagctgactacgtaacgttaccgggcaacggaccgtaacccccggggaacttccgggggtccctaggacgaccgtaattccgaagggttcggacacgggtcgggtactaggggacctagtactttcaacttcacaacccatccgagcacgccagcgaaggtcgtagaaagtgtggtacggtactaaggttttactaaccgtggttaccaatactaattaacttacttaccttaacgttcccgtacgggtactttcgggacgggacggtaaccgaagggtaaggagaacgttacgaaaccggttaagttcggg

SEQ ID NO: 353225 - DNA, 648 bp, Homo sapiens
  misc_feature: GZ8MTXP01AYB5D.4.33.C11.1.454.CMB.2.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (465)..(465): a, c, t, g, unknown or other
  misc_feature (465)..(465): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggagcttgggtccaggcccgaggggccgtccctgagactcgtcctgtacagcgtctggattcaacttcgagatttangcccatgaaccgtgggtccncaggcctcgagggggacggcgtgggtaggttgggttaggtttcagttagacgtcctagtggtcttagtcgcgtaaagggaacaacgagtaaacgcgccgtagttcgtaggtacgaaaggcaaggtattcatctatacctagaaaggngtaacgtaggtaacttacccggaaacggggtctaacgtcccggaccttaacgttcccgtagaccgaagtaacgtaggaaacctacgggtcccaaaggaaacggacccgaaaggacttacgacgttccggttattacgttaacgtggttaacggttaggttacgttttagtaagttttgggaag

SEQ ID NO: 353226 - DNA, 608 bp, Homo sapiens
  misc_feature: GZ8MTXP01DU364.4.33.C11.1.454.CMB.2.raw
tcagagcactgtagcacgaccggtgctcgatttagagtgagctcggttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtggggcgagacgggccaccatcaactgacaagtccagccagtagtgttaatatacagctaccaaacaatgaagaactacttagcttaggtatcagacaaagaaaccgaggacacgcctactaagctagctactacgtttaccgggcacgaccgtaacccccgggaagtccggggtcctaggacgacgtattcgagtcggacgacggtcgggtcgtggggaacctaggtacttccaactctacaaccgactacacgacacgcctagacgacggtacgtagtaaaggtagtaggtcggtacgttaaggtttaactttaacgtcgtactagtacctaattaactacgttacctacttccgtacggtcgttcgggcggaaggtaaccgtaaggtgaacgtattaaccgtaacgaacgtgg

SEQ ID NO: 353227 - DNA, 635 bp, Homo sapiens
  misc_feature: GZ8MTXP01CH39T.4.33.C11.1.454.CMB.2.raw
  modified_base (440)..(440): a, c, t, g, unknown or other
  misc_feature (440)..(440): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacagtcgtgatcgacccagtctccagactccctggctgtgtctcgtgggcgagacggccacatcaactgacaagtccagccaagtagttgttaatatacagcctaaccaaataatagaaagtaaacctacttaggtctttaggtaactaccgaagaccgaaacgaaaaccgaggacacggtaccccttaccgtaaagcgttcgactcgttaacgtttaccggggacaacgtacccgtaacccccggggaacgttccggggtacctagaacgccgtattcgagttcgggacngggtcgggtcgagggacagtacttacactctacacatcagcacgctacgcacgggtacgaagtaagtgtggtcgtacgttagtttacttacgtacgtacataactaattaactacttactccttacgtacggtcggttacggcgggttacgggaacgtaaggtaacgaagtacgttaacgtaacgttaacgtaag

SEQ ID NO: 353228 - DNA, 646 bp, Homo sapiens
  misc_feature: GZ8MTXP01BWBA3.4.33.C11.1.454.CMB.2.raw
  modified_base (215)..(215): a, c, t, g, unknown or other
  misc_feature (215)..(215): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (346)..(346): a, c, t, g, unknown or other
  misc_feature (346)..(346): n is a, c, g, or t
  modified_base (522)..(522): a, c, t, g, unknown or other
  misc_feature (522)..(522): n is a, c, g, or t
  modified_base (588)..(588): a, c, t, g, unknown or other
  misc_feature (588)..(588): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctggttttccttgttgctattttaaaaggtgtccaatgtgaggtgcagctggtggagtcgngggggagcttggtccagccagggcggtccctgagactctctgtacagcgtctggattcaacttcgngattangccatgacgtggccgcaggctcggagggagggcgtggaggtgggtgttacagttacggngtccgagtggctttagtcggcgtaaggggtaaaccaagaaagtaaacgttaacccgggcccgtcgttaccgtagggtaacggaaaagggcgtaaggtactttcattacgacttacctacgaaaggagtagtacgtaacttacccgaacggggtactacgtccgtacctacttccgngtacaggtagtaacgaacgacgccctaaggaaaacgcccggaaagaccgaacgtacgaccccgttnttaagtttaacgttagggttcgtttaaggggtagtttttacggtgttttaagggtaag

SEQ ID NO: 353229 - DNA, 662 bp, Homo sapiens
  misc_feature: GZ8MTXP01DU92H.4.33.C11.1.454.CMB.2.raw
  modified_base (236)..(236): a, c, t, g, unknown or other
  misc_feature (236)..(236): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttanatacagctacaaacaatgaagaactattagcttggtatcagacaagaaaccagacagacctactaaagctagctctagtttacccgggctaaggaccgtaaccccccggggtaaagtcccgggggtccctaggaacggaccgtaatttcgacggttaggggcaacgggtccgggggtacgtaggggaaccagtaactttccaactctacctaacccaactacaacgccgaacgcctcgacgacggacgttacgaaaggtagtagtaggtacgttagtttaagtttaaccgttagtacgtacgtacctaaattaactttacttaacttaccttaccgttaccggtacgtttaccgggttcgggacggggaaccggtaaacgggtaacgggtaaggaacgttaacgtaaaaccgttaaacgtaacggg

SEQ ID NO: 353230 - DNA, 653 bp, Homo sapiens
  misc_feature: GZ8MTXP01A98XK.4.33.C11.1.454.CMB.2.raw
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
  modified_base (354)..(354): a, c, t, g, unknown or other
  misc_feature (354)..(354): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggttttccttgttgcttattttaaaaggtgtaccaatgtgaggtgcagctggtggagtcgtgggggagcttggccagccgagggcgtccctgagactctcctgtacngcgtntggattctaactttcgtgtattangacctagtgaacgtcgggtccnccgaggcctccgagggggaacgggcgtggaggtgggtaggtttnagttaggagtcagtggtcttagtcgcgtgggaacaagagtaaactacggcgtcgtctaggagaagcagtacttcatcatctagaagtagattagacttcccgaacgctaactccgtacctatcccgtgaaccgtagacgttacgaacgtacgccgtaacggaaacggaacccggaagggaactaacccggacggtccccgtttataaagtttcccggttaggtttacgggttttaaggggttaacgtttttaggttaaggtttttagggagtttagtaacgtttaacgttttaaacccc

SEQ ID NO: 353231 - DNA, 617 bp, Homo sapiens
  misc_feature: GZ8MTXP01BSIDY.4.33.C11.1.454.CMB.2.raw
  modified_base (60)..(60): a, c, t, g, unknown or other
  misc_feature (60)..(60): n is a, c, g, or t
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (368)..(368): a, c, t, g, unknown or other
  misc_feature (368)..(368): n is a, c, g, or t
  modified_base (434)..(434): a, c, t, g, unknown or other
  misc_feature (434)..(434): n is a, c, g, or t
tcagagcactgtagcacgaccggtgctcgatttagagtgagctcgttgggttgggggganctacaacaggcaggcaggggcagcaagatggtgttgcagacccaggtcttcatttctctgttgctctggatctctggtgcctacggggacatcgtgatgacccagtctccagctccctggctgtgtctcgtgggcgagagggccacatcaactacaagtccagccagagtgtanatacagcaccaacaatgagaactacgtanactgtatcagcagaaacctaggacagcccnctagctgtctctacgtttaccggcgaacgtcgtacccgggaacccgtccggggtaccgtcgacgcggtacttacngggtggcgacgggtccgggtcgttaggggctagtactttacgtactactccacctagtacctcgancgctacgcgacgcgtaggggaaatgtaggtcgacgtagtttatttactacgttacgagtaccgaaatttctaactttacccgttaacctcccgttacgggtaaacggtttcccggggttacgggagggaaccccgggtaagggtagggaacgtaacggtcttaaaccggaacgttcggtaagg

SEQ ID NO: 353232 - DNA, 728 bp, Homo sapiens
  misc_feature: GZ8MTXP01E5CVF.4.33.C11.1.454.CMB.2.raw
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
tcagagcactgtagcacgaccggtgctcgatttagagtgagctcgttgggtttgggcttagctgggttttccttgttgctattttaaaaggtgtccaatgtgaggtgcagctggtggagtctggggggaggcttggtccagccagggcggtccctgagactctcctgtacagcgtctggattcaacttttcgtgattatgccatgaactggggtccgccaggctccgaggggaaggggctggagtgggtagtttcattagngcatggcttangctgggacaacagaaatacgccgcgtctgtagaaaggcagattcatcatctacaaagagatggatttacccgaaacggcaacttcccgacctaatcctgacaaaggaatgaaaccaggaccctaggaaacgaacccggaagggaaccacgacgccgttacttaattaactggttacggttaaggggttaagtttttaacggtaagttttttgggaaggttagggtaatttaaactttaaaccgttaaaacccccccttaacgttttacgtaaccgtttaaccggtcggggggtaccccgtaaacgggggtaaacccccgttggggtacccggtccccggttacctccccgtacaccggtaccccttacccgaaacccgaaccgggggaccccttaacgttcccgggttcccttccccccgtggtccccgaccccgttcgtccgttcccgtaacggg

SEQ ID NO: 353233 - DNA, 500 bp, Homo sapiens
  misc_feature: GZ8MTXP02JNJXE.4.33.C11.1.454.CMB.2.raw
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccccgggaatccggggtcctgagcgattcagtggcagcgggtctgggacagatttcactctcaccatcagcagcctgcaggctgagatgtgcagtttatactgtcagcaatacttctactactcctcggtactttcggcggaggaaccgaaggtacggacgagtacgaaacgaactgg

SEQ ID NO: 353234 - DNA, 518 bp, Homo sapiens
  misc_feature: GZ8MTXP02J0XHV.4.33.C11.1.454.CMB.2.raw
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctcaacaatgagaactacttagcttggtatcagcaagaaaccaggacagccctactaagctgctcattaccgggcagctacccccgggatccggggccctgagcgattcagtggcagcgggtctgggacagtatttcactctcaccatcagcagcctgcgaggctaggaagatggtaggctaggtttattacgtgtacagactaattacttctacctactccgtacggtactttcgggcggacgggaaccaagggtgagatacgaaaacgacgtagg

SEQ ID NO: 353235 - DNA, 500 bp, Homo sapiens
  misc_feature: GZ8MTXP02IZD1V.4.33.C11.1.454.CMB.2.raw
  modified_base (343)..(343): a, c, t, g, unknown or other
  misc_feature (343)..(343): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgaagaactacttagcttggtatcagcaagaaaccaggacagcctcctaagctgctcatttaccgggcagctaccccgggatccggggtccngagcgattcgagtggcagcgggtctggggacagatttcactctcaccatcagcagcctgcaggctgaagatgtgctagtttatactgtcagcaattatctactactcctcggtacttcggcggaggaaccgtaaggtcggagatacaaacgtactgg

SEQ ID NO: 353236 - DNA, 421 bp, Homo sapiens
  misc_feature: GZ8MTXP02J2AW4.4.33.C11.1.454.CMB.2.raw
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (377)..(421): a, c, t, g, unknown or other
  misc_feature (377)..(421): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaaacaatgagaactacttagcttggtatcagcagaaaccaggacagcctacctaagctgctcagtttaccgggnagctacccccgggatccggggtccctgagcgggctgggcaagggcncgagtaggngnnnnnnnnnnnnnnnnnnnnnnnnnnnnnnnnnnnnnnnnnnnnn

SEQ ID NO: 353237 - DNA, 494 bp, Homo sapiens
  misc_feature: GZ8MTXP02GXSUU.4.33.C11.1.454.CMB.2.raw
  modified_base (432)..(432): a, c, t, g, unknown or other
  misc_feature (432)..(432): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactactagcttggtatcagcaagaaaccaggacagcctctaagctgctcatttaccggcagctaccccgggatccggggtcctgagcgattcagtggcagcgggtctgggacagattcactctcaccatcagcagcctgcagcgtagaagagtagtgcgtagttattactgtcaganaatattactactactctacgtacgttcgtcgacggaacgagtaggagagtacaacgaactag

SEQ ID NO: 353238 - DNA, 497 bp, Homo sapiens
  misc_feature: GZ8MTXP02F2N3A.4.33.C11.1.454.CMB.2.raw
  modified_base (315)..(315): a, c, t, g, unknown or other
  misc_feature (315)..(315): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactactagcttggtatcagcagaaaccaggacagcctctaagctgctcatttaccgggnagctacccccgggatccggggtcctgagcgattcagtggcagcgggtctgggacagatttcactctcaccatcagcagcctgcaggctgaagatgtggactagtttatactgtcagcaatattctactactcctcgtacgttcggcggtacggaaccgaggtgacgagtacaaacgtactgg

SEQ ID NO: 353239 - DNA, 558 bp, Homo sapiens
  misc_feature: GZ8MTXP02F1Y4G.4.33.C11.1.454.CMB.2.raw
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
  modified_base (360)..(360): a, c, t, g, unknown or other
  misc_feature (360)..(360): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (472)..(472): a, c, t, g, unknown or other
  misc_feature (472)..(472): n is a, c, g, or t
  modified_base (511)..(511): a, c, t, g, unknown or other
  misc_feature (511)..(511): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttcctgttgctattttaaaggtgtccaatgtgaggtgcagctggtggagtcgtgggggagcttggtccagcccagggcggtccctgagactctcctgtacagcgtctggattcaactttcgngattatgccatgaactgggtccncaggcctcgaggggaagggctggagtgggtagtttcattagagcagtggcttangctagggacacgagaaataccgccgtgtcgtgtagaaagcagtattcgatcatctanaaaganatgaattcccgaaaggctagtccgaccttatcctgacagtatcgaaacncgaccgtagaacggaccgaggaaccacgacgtacccgtntaacgttaacgtgttacggttagggttattttacgtagttttggaag

SEQ ID NO: 353240 - DNA, 517 bp, Homo sapiens
  misc_feature: GZ8MTXP02INJ6P.4.33.C11.1.454.CMB.2.raw
  modified_base (407)..(407): a, c, t, g, unknown or other
  misc_feature (407)..(407): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtatatacagctccaacaatgagaactactagcttggtatcagcagaaacaggacagcctctaagctgctcatttaccgggcagctaccccggaatccggggcctgagcgattcagtggcagcgggtgtgggacagtattcactctcacatcagcagcctgcaggctagaagatggngcgtagtttatactgtcagctaattacttactactacttccgtacggtacgtttacggcggaacgggtaaccgtaacggtaggtacgaacgtacaaaacggaacttaggg

SEQ ID NO: 353241 - DNA, 536 bp, Homo sapiens
  misc_feature: GZ8MTXP02F2OH3.4.33.C11.1.454.CMB.2.raw
tcagagcactgtagcacgaccggtgctcgatttagagtgagctcgttgggtttgggcttagctgggttttccttgttgctattttaaaaggtgtccaatgtgaggtgcagctggtggagtctgggggaggcttggtccagccagggcggtccctgagactctcctgtacagcgtctggattcaacttttcgtgattatgccatgaactgggtccgccaggctccagggaaggggctggagtgggtaggtttcattagagccatgggcttatgctgggacaacagaatacgccgcgtctgtgaaaggcagattcatcatctcaagagatgattccaaacggcatccgcctatctgcagatgaacagcctgaagaccgaggacacagccgtctattactgtgttagggtagttttacgattttggagtggatattataaccccatttgactacgtggggccagggaaccctggtcgccgtctcctcacgcctccaccaacgggcccatcggtctcccctcggccgccctgcctcacgg

SEQ ID NO: 353242 - DNA, 518 bp, Homo sapiens
  misc_feature: GZ8MTXP02JRZAX.4.33.C11.1.454.CMB.2.raw
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaacaatgaagaactacttagcttggatcagcagaaaccaggacagcctacaagctgctcattaccggnagctaaccccgggatccggggtccctggagcgattcagtgcgagcgggtctgggacagtactttcactctcaccatcaagcagcctgcaggctaganatggtgactagtttatactgtcagtacaatacttactactacctcgtcggtacgtttcggacggtaggaaccgtaagggtcggaagactacgaaaacgtacgtcgg

SEQ ID NO: 353243 - DNA, 504 bp, Homo sapiens
  misc_feature: GZ8MTXP02IXWFL.4.33.C11.1.454.CMB.2.raw
  modified_base (368)..(368): a, c, t, g, unknown or other
  misc_feature (368)..(368): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgaagaactactagcttggtatcagcaagaaaccaggacagccctctaagctgctcattaccggcagcctaccccgggaatcccggggtcctgagcgattcgagtggcaggcgggtcnggggacagtattcactctcaccatcagcagctgcaggctagaagatggtgctagtttatacgtgtcagactaatacttctactactcgtcgtacgttcggcggaggaaccgaggtaggacgatacgaaacgactgg

SEQ ID NO: 353244 - DNA, 555 bp, Homo sapiens
  misc_feature: GZ8MTXP02GP01T.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaaacaatgaagaactacttagcttggtatcagcaagaaaccaggacagcctactaagctgctcacgtttaccgggcacgccgtaacccccggggaacgtcccggggtccctggacgcgtattccgagtggccgaggccggggtctgggacagtatttcactctcaccatcagcacgcctgcgacggctagaagagtggtaggcttaagtttattacgtcgtcgagactaaattacttactacctacttccgtacggtacgttcggacggtacggaaccgtaggtaggaagactacgaaacgtaacgtgg

SEQ ID NO: 353245 - DNA, 542 bp, Homo sapiens
  misc_feature: GZ8MTXP02GPKAF.4.33.C11.1.454.CMB.2.raw
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
tcagagcactgtagcacgaccggtgctcgattagagtgagctcggttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaacaatgaagaactacttagcttggtatcagcaagaaaccaggacagcctcctaagctgctcactttaccgggcagcctacccccgggaatccggggtccctgacgcgaattcgagtggcaggcgggtctggggacagtatttcactctcaccatccagcagccngacagctagaagngtggtgtacttagtttattacgtgtacagactaattacttactacttacctaccgtacgtacgttacggtacggacggaacggtacggtacggacgacgtaacgtaacgtaacgtacg

SEQ ID NO: 353246 - DNA, 552 bp, Homo sapiens
  misc_feature: GZ8MTXP02FWBTN.4.33.C11.1.454.CMB.2.raw
  modified_base (300)..(300): a, c, t, g, unknown or other
  misc_feature (300)..(300): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggagcttggtccagccaggggcggtccctgagactctcctgtacagcgtctggattcaactttcgtgattatgccatgaactgggtccnccaggctccgaggggaagggctggagtgggtagtttcattagagccatggcttatgctgggacaacagaaatacggccgcgtctggtagaaaggcagattcatcatctcaaagagatgattccaacgcatcgcctatctgcagatagaacagacctagaagacccggaggaacacgaacgccgtactactttacgtgtaggtttagggtaagttttacgtagtttttaggagttaggtattacgtttaaacc

SEQ ID NO: 353247 - DNA, 524 bp, Homo sapiens
  misc_feature: GZ8MTXP02HAMOH.4.33.C11.1.454.CMB.2.raw
  modified_base (240)..(240): a, c, t, g, unknown or other
  misc_feature (240)..(240): n is a, c, g, or t
  modified_base (407)..(407): a, c, t, g, unknown or other
  misc_feature (407)..(407): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggacgggccaccatccaactgacaagtccagccagagtgttanatacagctaccaacaatgaagaactacttagcttggaatcagcaagaaaccaggacagcctctaagctgctcatttaccgggcagcctaccccgggaatcccggggtacctgagcgatcagtggcagcgggtctgggacagtattcactctcaccatccagcagccncgacgagacgagagagtgtgtacgtagttattacgtgtatagatatacttactactactacgtacgtacgttacggtacggacggaacgaggtacggacgacgacgaacgtacgtag

SEQ ID NO: 353248 - DNA, 522 bp, Homo sapiens
  misc_feature: GZ8MTXP02GN9JV.4.33.C11.1.454.CMB.2.raw
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgaagaactacttagcttggtatcagcagaaaccaggacagcctcctaagctgctcatttaccgggcagctacccccgggatccggggtcctgagcgattcgagtggcagcgggtctggggacagatttcactcncaccatcancagcctgcaggctagaagatgtgctagtttattacgtgtcagtacaaattacttactacttactccgtacggtacctttacgggcggtaagggaaccgaagggtaggacgacgtacaaacgtaacgtgg

SEQ ID NO: 353249 - DNA, 538 bp, Homo sapiens
  misc_feature: GZ8MTXP02G1QWS.4.33.C11.1.454.CMB.2.raw
  modified_base (258)..(258): a, c, t, g, unknown or other
  misc_feature (258)..(258): n is a, c, g, or t
tcagagcactgtagcacgaccggtgctcgatttagagtgagctcgttgggtttgggggagtgtgaggggacatgagcggtagaaacagtggatatgtgtggcagtgtctgaccttggtgttttttgtttgtaggtgtccaatgtgaggtgcagctggtggagtctgggggaggcttggtccagccagggcggtccctgagactctcctgtacagcgtctggattcaactttcgtgattatgccatgaactggggtccnccaggctccgaggggaaggggctgggagtgggtaggttcattagagccatggcttatgctgggacaacagaatacgccgcgtctgtagaaaggcagattcatcatctacaaagagatgattaccaacggcatcgctatctgcagatgaacagcctagaagaccgaggacacagccgtctattactgtggttagggtagttttacgagtttttggagttggtattattaactaacccctatttcgactaacgtcgggaccacgggaccctggtccgcgtcc

SEQ ID NO: 353250 - DNA, 643 bp, Homo sapiens
  misc_feature: GZ8MTXP02HAIMD.4.33.C11.1.454.CMB.2.raw
  modified_base (368)..(368): a, c, t, g, unknown or other
  misc_feature (368)..(368): n is a, c, g, or t
tcagagcactgtagcacgaccggtgctcgatttagagtgagctcgttgggtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccgaggggaaggggctggaggtgggtagggtttctattagagccatggtcttatgcgtggacgaacagaatacgccgcgtctgtgaaaggacagattcatcatactcaagagatgattaccaacggcatccgcctatctgcagaatnaacagacctagaaacgaaccgaacggaactaacacgacccgttctaattaacgtgttaggtttaaggggtaagtttttaacgtagtttttgggagtaggtaattaatttaaccttaacccccaattttgaactacgtgggggccctaagggaacccttgggtccgcccgtccttcctaccgacgcccctaccgaaacccgaacggggccccctaagttcccgggttcccctttccccccgtcgggggccctcccccttcggcctacccgaagggg

SEQ ID NO: 353251 - DNA, 530 bp, Homo sapiens
  misc_feature: GZ8MTXP02IKP9W.4.33.C11.1.454.CMB.2.raw
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaaacaatgaagaaactacttagcttggtatcagacaagaaaccaggacagcctctaagctgctcattaccggcagcctaccccgggaatcccggggtcctgagcgatcagtggcagcgggtctgggacagtattcactctcaccatcagcagctgcaggctagaagntggngcgtagtttatactgtactaagactaaattacttactactacttccgtacggtaccgtttcggacggaacgggaaccgtaaggtaggacgtaactacgaaaacgtaacgtagg

SEQ ID NO: 353252 - DNA, 648 bp, Homo sapiens
  misc_feature: GZ8MTXP02HG8NQ.4.33.C11.1.454.CMB.2.raw
  modified_base (359)..(359): a, c, t, g, unknown or other
  misc_feature (359)..(359): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccagggcggtccctgagactctcctgtacagcgtctggattcaactttcgtgattatgccatgaactgggtccgccaggctccgaggggagggctggaggtgggtaggtttcagttagagccagtggcttancgctgggacaacgagaatacgccgcgtctgtagaaaggcagtattcatcatctacaaagagtatagtacttacccgaaacggctaacgtccgtacccttattcctagaccgaagtactacggaaaccacggaccctaaggaaacggaacccggaacgggaaccaacgacggtacccggttacttaacgtttaaccgttcggttacgggttttaaagggggttaacgtttttaacggttaaggttttttcggggaaggtttacgggttaactttaacgtttaaaaccccg

SEQ ID NO: 353253 - DNA, 524 bp, Homo sapiens
  misc_feature: GZ8MTXP02H4MJX.4.33.C11.1.454.CMB.2.raw
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
  modified_base (427)..(427): a, c, t, g, unknown or other
  misc_feature (427)..(427): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgacaagtccagccagagtntanatanagctaccaanatganaactactagcttgtancagacagaaaccagacacgcctaccaagctgctacacgttaccgggcacgaccgtaaccccgggacgtcccggggtccnggagcgtatcgagtggcaggcggtcgtgggacagtnttcactctcaccatccagcacgcctagcgagtcagaaagngtggtagtagttagttatacgtgacagactaatactactactactcgtacgtacgtacggtacggacggaacgagacgacgacgacgaacgaacgtg

SEQ ID NO: 353254 - DNA, 490 bp, Homo sapiens
  misc_feature: GZ8MTXP02FP28W.4.33.C11.1.454.CMB.2.raw
  modified_base (314)..(314): a, c, t, g, unknown or other
  misc_feature (314)..(314): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactactagcttggtatcagcagaaaccaggacagcctctaagctgctcatttaccgggnagctaccccgggaatcccggggtcctgagcgattcagtggcagcgggtctgggacagattcactctcaccatcagcagcctgcaggctgaagatgtggctagttatactgtcagcaatactctactactctcgtacttcggcgtaggaaccgaaggtcgagatacaaacgactagg

SEQ ID NO: 353255 - DNA, 556 bp, Homo sapiens
  misc_feature: GZ8MTXP02INSAS.4.33.C11.1.454.CMB.2.raw
  modified_base (320)..(320): a, c, t, g, unknown or other
  misc_feature (320)..(320): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctacaacatgagaactactagcttaggtatcagcaagaaaccaggacagccctactaagctgctcacgtttaccgggnacgccgtaaccccgggaagtcccggggtcctggacgcgattccgagtggcaggcggggtctagggacagtattcactctcacatcagcagcctgcaggcagaagatggtagctagtttattacgtgtacagactaattactactactaccttccgtacggttaccgtttccgggacggtaacgggaaccgtaaaggggttacggacgtaacgtaaccgaaaacggttaacgtcggg

SEQ ID NO: 353256 - DNA, 496 bp, Homo sapiens
  misc_feature: GZ8MTXP02IV41O.4.33.C11.1.454.CMB.2.raw
  modified_base (314)..(314): a, c, t, g, unknown or other
  misc_feature (314)..(314): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaaacaatgaagaactactagcttggatcagcaagaaaccaggacagccctctaagctgctcattaccggnagcctaccccgggatccggggtcctgagcgattcgagtggcagcgggtctgggacagtattcactctcaccatcagcagcctgcaggctagaagagtgtggactagtttatacgtgtcagacaatactctactactccgtacgtacttcggcgaggaacgaaggtgacgatacaacgtactg

SEQ ID NO: 353257 - DNA, 517 bp, Homo sapiens
  misc_feature: GZ8MTXP02HYP57.4.33.C11.1.454.CMB.2.raw
  modified_base (289)..(289): a, c, t, g, unknown or other
  misc_feature (289)..(289): n is a, c, g, or t
  modified_base (390)..(390): a, c, t, g, unknown or other
  misc_feature (390)..(390): n is a, c, g, or t
  modified_base (436)..(436): a, c, t, g, unknown or other
  misc_feature (436)..(436): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaaacaatgaagaaactacttagcttggtatcagcaagaaaccnggacagcctacctaagctgctcatttaccgggcagcctaccccggggatcccggggtcctgagcgattcgagtggcagcgggtctgggacagattcactcncaccatcagcagcctgcaggctgaagatggtggctagtttattacngtacagtcaaattattctactactcctcggtactttcggacggagggaaccgaaggtaggacgataccgaaacgtaactgg

SEQ ID NO: 353258 - DNA, 543 bp, Homo sapiens
  misc_feature: GZ8MTXP02G437V.4.33.C11.1.454.CMB.2.raw
  modified_base (423)..(423): a, c, t, g, unknown or other
  misc_feature (423)..(423): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgaagaactacttagcttggtatcagcagaaaccaggacagcctctaagctgctcagttaccgggcagcctaacccccggggatcccggggtccctggacgcgattcgagtggcaggcgggtctgggacagtatttcactctcaccatcagcacgcctgcaggctaggaagtntggtgactagtttatacgtgtcagactaaattacttactaactacctccgtacggttaccgtttcgggacggtaacgggaaccgtaaggtacggagtacgtaacaaaacggtaacgtggg

SEQ ID NO: 353259 - DNA, 549 bp, Homo sapiens
  misc_feature: GZ8MTXP02G25GF.4.33.C11.1.454.CMB.2.raw
  modified_base (311)..(311): a, c, t, g, unknown or other
  misc_feature (311)..(311): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggcttggtccagccaggggcggtccctgagactctcctgtacagcgtctggattcaactttcgtgatttatgccatgaactgggtccnccaggctccgaggggagggctgggagtggggtagttcattagagccatggcttatgctgggacacagaaactacggccgcgtctgtagaaaggcaagattcatcatctacaaagagatgtattccgaaacggctagtccgacctatcctgcagatagaacagcctagaacgaccgagacaacgacgccgtataacttaacgtggtaggttagggtattttacggtagtttttggaagg

SEQ ID NO: 353260 - DNA, 557 bp, Homo sapiens
  misc_feature: GZ8MTXP02JWHBL.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttatatacagctaccaacaatgagaactactagcttggtatcagcagaaaccaggacagcctctaagctgctcagttaccggcacgcctacccccgggaagtccggggtccctggacgcgattcgaggtggcaggcgggtctgggacagatttcactctcacatcagcagcctgccaggctaggaagagtggtaggactaaggtttattaacgtcgtacagtactaattacttacctaacctacctccgttacggtaccgtttacgggacgggtacgggaaccgtaagggttacggaagtacgtaaccgtaaaacgacgtaggg

SEQ ID NO: 353261 - DNA, 530 bp, Homo sapiens
  misc_feature: GZ8MTXP02G7N4Y.4.33.C11.1.454.CMB.2.raw
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttcctgttgctattttaaaggtgtccaatgtgaggtgcagctggtggagtcgtgggggaggcttggtccagccaggggcggtccctgagactctcctgtacngcgtctggattcaactttcgngatttangccatgaactgggtccnccaggctccgaggggagggctggagtgggtaggtttcattagagccatggcttatgctggggacacgagaaatacgccgcgtcgtgtagaaaggcagattcatcatctcaagagatgattccaacggcatcgacctatctgcagatgaacagcctagaacgaccgaggacacacgccgtactattaacgtgtagttagggtagtttacgtagttttaggtagg

SEQ ID NO: 353262 - DNA, 533 bp, Homo sapiens
  misc_feature: GZ8MTXP02FTVW3.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctcaacaatgagaactactagcttggtatcagcaagaaaccaggacagcctactaagctgctctacgtttaccgggcacgcctaacccccggggaactcccggggtaccctggagccgaattcgagtggcagcgggtctgggacagtattcactctcaccatcagcacgcctgcaggctagaagatgtgactagtttatactgtcagactaatacttactactactccgtacggtacgtttacggcggtaagggaaccgaagggtcggaagtactacgaaaacgtactagg

SEQ ID NO: 353263 - DNA, 604 bp, Homo sapiens
  misc_feature: GZ8MTXP02JWJOS.4.33.C11.1.454.CMB.2.raw
  modified_base (309)..(309): a, c, t, g, unknown or other
  misc_feature (309)..(309): n is a, c, g, or t
  modified_base (364)..(364): a, c, t, g, unknown or other
  misc_feature (364)..(364): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggaggcttggtccagccaggggcggtccctgagactctcctgtacagcgtctggattcaactttcgtgatttatgccatgaactgggtccnccaggcctccgaggggagggctgggagtgggtagttcattagagccatggcttangcgtggggacacgagaaactaccgccgtacgtctggtagaaagcagattcatccatcctacaaagagatgacttacccgaacgggctagtccgaccttatccgtgacctaggaattacggaaacacgtacccgtaggaaaacggacccggaacgggaccaaccgacgtaccccgttcttaagttaaccgtaggtttacggtttacgggggttattttaccggttagtttttagggtaagg

SEQ ID NO: 353264 - DNA, 606 bp, Homo sapiens
  misc_feature: GZ8MTXP02IRSVE.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagtgttatatacagctaccaaacaatgaagaactacttagcttaggtatcagacaagaaaccaggacagccctactaagctgctacgtacgtttacccgggcaacggccgtaaccccccggggaacgtcccggggtaccctggacgcgtattcgaggttggaccgtaggccggggtctgggacctagtatttccacctctaccaccatccacgcacgccgtgacgaggctagaagagtggtagtacgtaggtttacttagtcgtacagtacaaattacttacttacctacttacccgtacggttaccgtttaccgggacgggtaacgggaaccgtaagggtaggaacgtaacgtaacgaaaaccggaacgttcgg

SEQ ID NO: 353265 - DNA, 488 bp, Homo sapiens
  misc_feature: GZ8MTXP02JCBL5.4.33.C11.1.454.CMB.2.raw
  modified_base (364)..(364): a, c, t, g, unknown or other
  misc_feature (364)..(364): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcaagctgctcatttaccgggcagctaccccgggaatcccggggtccctgagcgattcagtggcagcgggtntggggacagatttcactctcaccatcagcagcctgcagctgaagatgtgctagtttattactgtcagcaatatctactactctacgcttcggcgaggaaccgaaggtcgagatacaaacgactg

SEQ ID NO: 353266 - DNA, 539 bp, Homo sapiens
  misc_feature: GZ8MTXP02GTHC6.4.33.C11.1.454.CMB.2.raw
  modified_base (395)..(395): a, c, t, g, unknown or other
  misc_feature (395)..(395): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgttatgacccagtctccagactccctggctgtgtctctgggcgagagggccacatcaactgcaagtccagccagagtgttatatacagctccaacaatgagaactacttagcttggtatcagcagaaaccaggacaagctcctaagctgctcatttaccgggcagctaccggaactccggggtccctgagcgattcagtgcagcgggtctgggacagatttcactctcaccatcagcagcccncgcgacgcgtagaagtagtagtggtagtagttattacttagtactagtactaataacttactactacctaccgtaccgtacgttacggtacggacggaacggaacggtaacggtaacgaacgaacgaaacgaaacgtacgtacg

SEQ ID NO: 353267 - DNA, 537 bp, Homo sapiens
  misc_feature: GZ8MTXP02JRUMA.4.33.C11.1.454.CMB.2.raw
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (355)..(355): a, c, t, g, unknown or other
  misc_feature (355)..(355): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggtttcctgtgctatttaaaggtgtccaatgtgaggtgcagctggtggagtcgtgggggaggcttggtccagccagggcggtccctgagactctcctgtacagcgtctggattcaattttcgngattatgccatgaactgggtccncgagctcgaggggaggctggagtgggtagtttcattagacgcagtggcttangcgtggaacacgagaactaccgcgtcgtctaggacgaaagcagattacatcatctanaaganatagtactaccgaacgctacgtcgactatcgtgacgaagacgacgaacgcgacgtacgaacgacgacgacacgacgtctatattgtagttaggttacggttagtttacgttagtttggag

SEQ ID NO: 353268 - DNA, 506 bp, Homo sapiens
  misc_feature: GZ8MTXP02GHKI1.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttatatacagctccaacaatgagaactactagcttggtatcagcagaaaccaggacagcctctaagctgctcattaccggcagctacccccgggaatccggggtcctgagcgattcagtggcagcgggtctggggacagatttcactctcaccatcagcagcctgcaggctgaagatgtgactagtttattactgtcagacaatacttactactactcctacgtacgtttcggacggacggtaaccgaaggtaggagatacgaaacgaactgg

SEQ ID NO: 353269 - DNA, 540 bp, Homo sapiens
  misc_feature: GZ8MTXP02IZ2V0.4.33.C11.1.454.CMB.2.raw
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (360)..(360): a, c, t, g, unknown or other
  misc_feature (360)..(360): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttcctgttgctattttaaaggtgtccaatgtgaggtgcagctggtggagtcgtgggggagcttggtccagccaggggcggtccctgagactctcctgtacagcgtctggattcaactttcgngatttatgccatgaactgggtccnccaggctccgaggggagggctggagtgggtagtttcattagagcatggcttangctgggacacgagaaataccgccgcgtctagtagaaaggcagattcatcatctacaagagatgaattaccaaacggcaagtccgacctatctagcagatagaacagcctagaacgaccgaggacacgacgccgtactattaacgtgtacggttagggtagtttacgtagtttttaggaag

SEQ ID NO: 353270 - DNA, 515 bp, Homo sapiens
  misc_feature: GZ8MTXP02INFJT.4.33.C11.1.454.CMB.2.raw
  modified_base (319)..(319): a, c, t, g, unknown or other
  misc_feature (319)..(319): n is a, c, g, or t
  modified_base (373)..(373): a, c, t, g, unknown or other
  misc_feature (373)..(373): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaacaatgaagaactactagcttggtatcagcaagaaaccaggacagcctactaagctgctcagttaccggnacgcctaccccgggaatcccggggtcctgacgcgtatcgagtggcaggcgggtngggacagtattcactctacaccatcagcagcctgcagctagaagatgtgctagtttatactgtacagtacaattacttactactacctcgtacgtacgttcggacggaggaaccgtaggtagacgagtacaaacgtactcgg

SEQ ID NO: 353271 - DNA, 511 bp, Homo sapiens
  misc_feature: GZ8MTXP02IZXWF.4.33.C11.1.454.CMB.2.raw
  modified_base (234)..(234): a, c, t, g, unknown or other
  misc_feature (234)..(234): n is a, c, g, or t
  modified_base (370)..(370): a, c, t, g, unknown or other
  misc_feature (370)..(370): n is a, c, g, or t
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtanatacagctccaacaatgagaactacttagcttggtatcagcaagaaaccaggacagcctctaagctgctcatttaccgggcagcctacccccgggaatcccggggtccctgagcgattcgagtggcgagcggggtntggggacagtatttcactctcaccatcagcagcctgcaggctaggaantgtgactagtttatactgtcananaatacttactactactcctcgtcgttacggtcggaggaacgaaggtacggagagtacaaacgaacgtag

SEQ ID NO: 353272 - DNA, 530 bp, Homo sapiens
  misc_feature: GZ8MTXP02HBOMG.4.33.C11.1.454.CMB.2.raw
  modified_base (377)..(377): a, c, t, g, unknown or other
  misc_feature (377)..(377): n is a, c, g, or t
  modified_base (422)..(422): a, c, t, g, unknown or other
  misc_feature (422)..(422): n is a, c, g, or t
  modified_base (448)..(448): a, c, t, g, unknown or other
  misc_feature (448)..(448): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaaacatgaagaactacttagcttaggtatcagacaacgaaaccaggacagcctacaagctgctacacgttaccggcagccgtaccccgggactcccggggtcctgacgcgattcgagtcgcaggcggtngggacagacttcactctcacatcagcacgctgcgaggctagaagngtggtgacttagtttactacgtgtanagactaattacttctactactccgtacggtaccgttcggacggaacggaacgtaggtacggagactacgaaacgtaacgtgg

SEQ ID NO: 353273 - DNA, 614 bp, Homo sapiens
  misc_feature: GZ8MTXP02JKJMI.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggagggccaccatcaactgacaagtccagccagagtgttatatacagcctccaaacaatgaagaactactagcttggtatcagcaagaaaccaggacagcctactaagctgctcacgtttaccgggcacgccgtaacccccgggaacgtcccggggtccgtcgacgacgtactcgacgtggcgaggcgggtcgtgggacgagtacgttactactctctaccactcacgacacgccgtcgacgacggcgtagaagtagtagggtaggtcgttaagtttacgttactacgtaccgtaagtactaacttaactttacttacctaccttacccgttaccggttaccgttaccggggtacgggaacgggtaaccggaacggttaggacggtaacgtaacgtaaaacgtaacgttacggg

SEQ ID NO: 353274 - DNA, 523 bp, Homo sapiens
  misc_feature: GZ8MTXP02JZ1ZC.4.33.C11.1.454.CMB.2.raw
  modified_base (320)..(320): a, c, t, g, unknown or other
  misc_feature (320)..(320): n is a, c, g, or t
  modified_base (409)..(409): a, c, t, g, unknown or other
  misc_feature (409)..(409): n is a, c, g, or t
  modified_base (510)..(510): a, c, t, g, unknown or other
  misc_feature (510)..(510): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaacaatgaagaactacttagcttggtatcagcaagaaaccaggacagcctactaagctgctcagttaccgggnacgccgtaccccggggaatcccggggtcctgagcgattcgagtggcaggcgggtctgggacagtattcactctcacatcagcacgccgngacgagacgtagagtagtggtagtacttagtttatacgtcgtagagtactaattactactactacctcgtcgtacgtcggacggacgaacgaggacgacanacgaacgtacgtg

SEQ ID NO: 353275 - DNA, 544 bp, Homo sapiens
  misc_feature: GZ8MTXP02HOVOU.4.33.C11.1.454.CMB.2.raw
  modified_base (236)..(236): a, c, t, g, unknown or other
  misc_feature (236)..(236): n is a, c, g, or t
  modified_base (288)..(288): a, c, t, g, unknown or other
  misc_feature (288)..(288): n is a, c, g, or t
  modified_base (379)..(379): a, c, t, g, unknown or other
  misc_feature (379)..(379): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttanatacagctaccaacaatgaagaactacttagcttggtatcagcaagaaaccnggacagcctacaagctgctcagttaccgggcaggcctaccccccggggaagtcccggggtcctggagccgattcgagtggcaggcgggtcngggacagtattcactctcacatcagcacgctgcaggctagaagatggtgctaagtttactacgtgtacagtactaaattacttactaaccttacctcccgtacggtaccgtttcggacggtagggaacccgtagggtaggaacggtatacgaaaacgtaacgtgg

SEQ ID NO: 353276 - DNA, 536 bp, Homo sapiens
  misc_feature: GZ8MTXP02H96IJ.4.33.C11.1.454.CMB.2.raw
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttcctgttgctattttaaaggtgtccaatgtgaggtgcagctggtggagtctgggggagcttggtccagccagggcggtccctgagactctcctgtacagcgtctggattcaactttcgngatttatgccatgaactggggtcccnccaggctccgaggggagggctggagtgggtagttcattagngcatggcttangctgggacacagaaataccgccgngtcngtagaaagcagattcatcatctacaagagatagattaccgaacggctaatcgcctatctgcagatagaacacgacctagaaacgaccgaacgacgaacacgccgtactataacgtgtaggttaggtagtttacggtagttttaggtagg

SEQ ID NO: 353277 - DNA, 569 bp, Homo sapiens
  misc_feature: GZ8MTXP02J0MHB.4.33.C11.1.454.CMB.2.raw
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (315)..(315): a, c, t, g, unknown or other
  misc_feature (315)..(315): n is a, c, g, or t
  modified_base (368)..(368): a, c, t, g, unknown or other
  misc_feature (368)..(368): n is a, c, g, or t
  modified_base (464)..(464): a, c, t, g, unknown or other
  misc_feature (464)..(464): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctgggtggagtcgtggggggaggcttgggtccagcccaggggccggtccctgagactctcctgtacngcgtctggattcaacttttcgngatttatgccatgaactgggtccncaggctccgagggagggctggagtgggtagtttcattagagccagtggcttangctggggacacagaataccgccgatctgagaaagcagattcatcatctacaagagatgattaccaacggcatcgacctatctgacaggatagaacngacccgtagaaacggaccggaggaaaccacgacgaccccgtcgtaacttaaccgtggttacggtttaacggggttacgtttttacggtaagtttttaggtaaggg

SEQ ID NO: 353278 - DNA, 569 bp, Homo sapiens
  misc_feature: GZ8MTXP02JKU9A.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaaacaatgaagaactacttagcttggtatcagcaagaaaccaggacagcctacctaagctgcctcacgtttaccgggcacgcctaacccccggggaatcccggggtcctggacgcgtattcgagtggcgagcgggtctgggacagtattcactctcaccatcagcacgcctgaccgaggctaggaagtagtggtaggtactaggtttacttacgtgtacaagtactaaattacttactactacctccgtacggttacgttcgggacggaacgggtaaccgtaagggtaggaacgtacgtaaccgaaaacggtacgtacggg

SEQ ID NO: 353279 - DNA, 503 bp, Homo sapiens
  misc_feature: GZ8MTXP02FYOVZ.4.33.C11.1.454.CMB.2.raw
  modified_base (422)..(422): a, c, t, g, unknown or other
  misc_feature (422)..(422): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaaacaatgagaactacttagcttggtatcagcaagaaaccaggacagcctactaagctgctcagtttaccggcagccgtacccccggggaatcccggggtcctgacgcgattcgagtggcgagcgggtctgggacagatttcactctcaccatcagcagcctgcaggctagagatgngctagtttatactgcagcaatactctactactcgtcgtacttcggcggtaggaacgaaggtcgagactacaaacgactagg

SEQ ID NO: 353280 - DNA, 541 bp, Homo sapiens
  misc_feature: GZ8MTXP02GXQR0.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgaagaactacttagcttaggtatcagcaagaaaccaggacagcctactaagctgctcacgtttaccgggcacggctaccccccggggaatcccggggtccctggacgcgattcgagcggcaggcgggtctgggacagtatttcactctcaccatcagcagcctgacgaggctagaagagtggtggactagtttatactgtacagctaaattacttactactaccttccgtacggtacgttccgggacggtacgggaaccgtaaggtggaacgagtaacgaaacgacgtgg

SEQ ID NO: 353281 - DNA, 523 bp, Homo sapiens
  misc_feature: GZ8MTXP02INISF.4.33.C11.1.454.CMB.2.raw
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
  modified_base (388)..(388): a, c, t, g, unknown or other
  misc_feature (388)..(388): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaggtgtccaatgtgaggtgcagctgggtggagtcgtgggggaggcttggtccagccagggcggtccctgagactctcctgtacagcgtctggattcaactttcgngattatgccatgaactgggtccncaggctccagggaaggggctggagtggggtagtttcattagagccatggcttatgctggggacacagaatacgccgcgtcngtgaaagcagattcatcatctacaagagatagattaccaaggcatcgcctatctgcagatgaacagcctgaagaccgacgacacacgccgtactattaactgtagttagggtagtttacgtagtttttggtaagg

SEQ ID NO: 353282 - DNA, 681 bp, Homo sapiens
  misc_feature: GZ8MTXP02G85R6.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacgggccaccatcaactgacaagtccagccagagtgttatatacagcctacaaacatgaataactacttagcttaggatcgaagacaaacgaaaccgaggaccacgcctactaagctcgctacgtacgttaccggcacggtaccgtacccccggggacgtcccggggtcctaggacgtcgtacttccggaggtcggccgacgggtccggggtcgtacggggaactacgttactttaccgaacttccgtacccaacccgtattacccgaaacggtcccgtaacgaccccgttgacccgaggggtaccttaagggaaacgttcggttagggttacggtaccttaaaggttttacctagtacggtacctaagtactaactttacttaccttaaccgtaccgttccggtacggtaccggtttacggggacggtaacggggaaccgtaggggtaggaacgtaacgtaaccggaaaacgtacgtgg

SEQ ID NO: 353283 - DNA, 601 bp, Homo sapiens
  misc_feature: GZ8MTXP02IFSL4.4.33.C11.1.454.CMB.2.raw
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
tcagagcactgtagcacgaccggtgctcgatttagagtgagctcgttgggtttgggagctctgggagaggagccccagccgtgagattcccaggagtttccacttggtgatcagcactgaacacagaccaccaaccatggagtttgggcttagctgggttttcctgttgctattttaaaggtgtccaatgtgaggtgcagctggtggagtcgtgggggagcttggtccagccgagggccgtccctgagactctcctgtacagtcgtctggattcaactttcgngattangccatgaacgtggtccncgaggctccgagggagggctggaggtgggtagttcagttagagccagtcggtcttagtcgcgtaggggaactacgaagtaaactaccggcccgtacgttcgagtaggaaaggtcagtatacatctatctacaaagagatagtacgttacccgaacggactacgtacccgtacctaactccgtagacgaagtagtacgaacacgacgtacggaaacgaccggaacgacaacgacgtaccgtacttacgttaacgtgttacggttacggttaagttttacgttagtttttaggaagg

SEQ ID NO: 353284 - DNA, 553 bp, Homo sapiens
  misc_feature: GZ8MTXP02F46V1.4.33.C11.1.454.CMB.2.raw
  modified_base (319)..(319): a, c, t, g, unknown or other
  misc_feature (319)..(319): n is a, c, g, or t
  modified_base (388)..(388): a, c, t, g, unknown or other
  misc_feature (388)..(388): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctcaacatgagaactactagcttaggtatcagcaagaaaccagacagcctactaagctgctctacgtttaccgggnacgtaccgtacccccggggaatcccggggtacctagacgcgtacttcgagtcggacaggccggggttcnggggactagtatttcgactctacaccatcagcagcctgcgagctagaagtactggtggacctagtttacttacgtcgttacagtacaattacttcttactactcctacggtacttacgggcggtaggaaccgaagggtaggaacgacgtaacgaaacgaacgtgg

SEQ ID NO: 353285 - DNA, 510 bp, Homo sapiens
  misc_feature: GZ8MTXP02I1UQ6.4.33.C11.1.454.CMB.2.raw
  modified_base (235)..(235): a, c, t, g, unknown or other
  misc_feature (235)..(235): n is a, c, g, or t
  modified_base (491)..(491): a, c, t, g, unknown or other
  misc_feature (491)..(491): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttanatacagctccaacaatgagaactacttagcttggtatcagcagaaaccaggacagcctctaagctgctcatttaccgggcagcctaccccgggaatcccggggtccctgagcgattcgagtggcagcgggtctgggacagatttcactctcaccatcagcagcctagcaggctgaagatgtgctagtttatactgtcagactaatcttactactactcctcggtactttcggacggagggtaaccgaggtacgganacgtacaaacgacgttagg

SEQ ID NO: 353286 - DNA, 500 bp, Homo sapiens
  misc_feature: GZ8MTXP02FTFN5.4.33.C11.1.454.CMB.2.raw
  modified_base (315)..(315): a, c, t, g, unknown or other
  misc_feature (315)..(315): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttatatacagctccaacaatgagaactactagcttggtatcagcaagaaaccaggacagcctctaagctgctcattaccgggnagctaccccgggaatcccggggtcctgagcgattcagtggcagcgggtctgggacagatttcactctcaccatcagcagcctgcaggctagaagatgtgctagtttattactgtacagacaatacttctactactctacggtactttcggcggtaggaaccgaaggtgagatacaaacgactagg

SEQ ID NO: 353287 - DNA, 525 bp, Homo sapiens
  misc_feature: GZ8MTXP02JN1RS.4.33.C11.1.454.CMB.2.raw
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtctgggggagcttggtccagccagggcggtccctgagactctcctgtacagcgtctggattcaactttcgngattatgccatgaactggggtccnccaggctccgagggaaggggctgggagtgggtaggtttcagttagagtccatggcttangctgggacacgagaatacgccgacgtctgtagaaagcagattcatcatcacaagagatgattccaacggcatcgctatctgcagatgaacagcctagaagaccgaggacacacgcctactataacgtgtaggttaggtagtttacgtagttttaggtagg

SEQ ID NO: 353288 - DNA, 571 bp, Homo sapiens
  misc_feature: GZ8MTXP02JVFYQ.4.33.C11.1.454.CMB.2.raw
  modified_base (307)..(307): a, c, t, g, unknown or other
  misc_feature (307)..(307): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccagggcggtccctgagactctcctgtacagcgtctggattcaactttcgtgattatgccatgaactgggtccncaggctccgaggggagggcgtggagtgggcaggtttcagttagagccccagtggcttatgcgtagggacaacgaagaactacgccgcgtctgtagaaaggcagtattcatcatctacaaagagtatagacttacccgaaacgggctaacgttccgacccttaatccgtaggacagactagaaacagtccctaggaaacgaccggagaacacgacgcccgtataagtacgtggttacgttaagggtattttacgagtttttaggg

SEQ ID NO: 353289 - DNA, 546 bp, Homo sapiens
  misc_feature: GZ8MTXP02FV3E4.4.33.C11.1.454.CMB.2.raw
  modified_base (179)..(179): a, c, t, g, unknown or other
  misc_feature (179)..(179): n is a, c, g, or t
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (413)..(413): a, c, t, g, unknown or other
  misc_feature (413)..(413): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggtttcctgtgctatttaaaggngtccaatgtgaggtgcagctggtggagtcgtgggggaggcttggtccagcccaggggcggtccctgagactctcctgtacagcgtctggattcaactttcgtgattatgccatgaactgggtccncaggctccgaggggagggctggagtgggtagtttcattgagcagtggcttangctagggacacagaactacgccgcgtctgtacgaaagcagatcatcatctacaaganatgattaccgaacggcatccgacctatccgtgcaagatagaactagcctagaacggaccggaggaacacgacgtccgtacttacttaacgtgttacggttacgggttagtttttacggtagtttttggtaagg

SEQ ID NO: 353290 - DNA, 527 bp, Homo sapiens
  misc_feature: GZ8MTXP02JDLIO.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaacaatgagaactacttagcttggtatcagacaagaaaccaggacagcctacctaagctgctcattaccgggcagcgtaccccgggatcccggggtcctgacgcgattcgagtggcgagcgggtctgggacagtattcactctcaccatccagcagcctgcgaggctaggaagatggtgacgtagtttattacgtgtacagactaattacttactactaccgtcctacggtacgttcggacggacggaaccgaaggtcggagacgtacgaaacgacgtagg

SEQ ID NO: 353291 - DNA, 504 bp, Homo sapiens
  misc_feature: GZ8MTXP02HXOBP.4.33.C11.1.454.CMB.2.raw
  modified_base (235)..(235): a, c, t, g, unknown or other
  misc_feature (235)..(235): n is a, c, g, or t
  modified_base (417)..(417): a, c, t, g, unknown or other
  misc_feature (417)..(417): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgttanatacagctccaacaatgagaaactacttagcttggtatcagcagaaaccaggacagcctcctaaagctgctcatttaccgggcagctacccccggggaatcccggggtccctgagcgattcagtggcagcgggtctgggacagatttcgactctcaccatcagcagcctgcagctgagatgngcagtttattactgtcagcaaatattctactactccgtacgtactttcggcggaggaaccgaggtaggacgagtacaaacgactagg

SEQ ID NO: 353292 - DNA, 524 bp, Homo sapiens
  misc_feature: GZ8MTXP02H1LPO.4.33.C11.1.454.CMB.2.raw
  modified_base (287)..(287): a, c, t, g, unknown or other
  misc_feature (287)..(287): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcagagggccacatcaactgcaagtccagccagagtgttatatacagctaccaaacaatgaagaactacttagcttggtatcagcaagaaaccnggacagcctactaagctgctcattaccgggcagcctaccccgggatcccggggtcctgagcgatcgagtggcagcgggtctggggacagattcactctcaccatccagcagcctgaccaggctaggaacgtagtggtggactagtttacttacgtgtacagactaaattacttctaacttctccgtacggtactttcgggacggaggaaccgaggtacgacgatacgaacgtactgg

SEQ ID NO: 353293 - DNA, 613 bp, Homo sapiens
  misc_feature: GZ8MTXP02JHV3B.4.33.C11.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgaggagggccaccatcaactgcaagtccagccagagtgtatatacagctacaanaatgaanaactacttagcttggtatcagcaagaaaccaggacacgcctactaagctgctctacgttaccgggcacgccgtaacccccggggaatcccggggtcctggacgcgtattcgaggtggcgagggcggggtcgtggggaacagtactttcgactctacaccatcacgcagccctgacgtagggctaggaagagtcggtaggtacgttagtttattacgtcgtacgaagtactaaacttacttaccttaacctacccgttcccttacgggttaccgtttaccgggggaccggggtaacggggaaccggtaacggggttacggaaacgtaacgtaaccgaaaacggtacgttacgggg

SEQ ID NO: 353294 - DNA, 624 bp, Homo sapiens
  misc_feature: GZ8MTXP02GO5PE.4.33.C11.1.454.CMB.2.raw
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtcctccagacctccctggctgtgtctcgtgggcgaggcgggccaccatcaactgacaagtccagccagtagtgttatatacagcctaccaacaatgaagaactactagcttggtatcagcaacgaaaccgaggacacgcctactaagctgctactacgttaccgggcacgtccgtacccccggggacgtccccggggtcctggacgcgtattccgaggtcggcgaggtcgggtcgtaggggactagtactttcactctacacatcagcacgtccngaccaggctaggaagngtaggtcgacgttagtttacttacgtgtaccgtagtacctaaattacttaccttaaacgttacccttacccgtaccgggtttaccggtttaccggggaccggggtaacgggtaaacccgtaagggggttacggaaaggtacgtaaaccgaaaacggtaacgttcggg

SEQ ID NO: 353295 - DNA, 589 bp, Homo sapiens
  misc_feature: GZ8MTXP02JTKB2.4.33.C11.1.454.CMB.2.raw
  modified_base (376)..(376): a, c, t, g, unknown or other
  misc_feature (376)..(376): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtatgaccacgtctccacgactccctcggctgtgtctctgggcgaggagggccaccatcaactgcaacgtccagccagagtgttatatacagctaccaaacaatgaagaaactacttagtcttggtatcagacaagaaaaccaggaacacgcctacctaagctgctctacgttaccgggcagaccgtacccgggaacgtcccggggtccgtgacggcgattcnggtcggcaggcggggtctggggacagtatttccactctcaacntcngcagccgtgtacggctagaagntggtggacttaagtttatactgacaagntaaattnttccgtactaccttccgtacgggtaacgtttcggggcggggaaacgggtaacctagggggtaacgggaactaacgttaaccggaaaaaccggtacttgggggtctacccg

SEQ ID NO: 353296 - DNA, 564 bp, Homo sapiens
  misc_feature: GZ8MTXP02HYMK8.4.33.C11.1.454.CMB.2.raw
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccaggggcggtccctgagactctcctgtacagcgtctggattcaacttttcgngatttangccatgaactggggtcccnccaggcctccgaggggaggggctgggagtgggtagtttcattagngcatggcttangntgggacanagaaatacgccgcgtctgtagaaaggcaagattcatcatctacaagagatagattaccaacggcatcgtcctactctgcagatagaaacacgaccgtagaaacggaccgaacggaaccgacacgaccgtctacgtttaacgtggttacggttagggttagtttttacggttagtttttaggtagg

SEQ ID NO: 353297 - DNA, 534 bp, Homo sapiens
  misc_feature: GZ8MTXP02GVZJG.4.33.C11.1.454.CMB.2.raw
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggtttcctgtgctatttaaaggtgtccaatgtgaggtgcagctggtggagtctgggggagcttggtccagccagggcggtccctgagactctcctgtacagcgtctggattcaactttcgtgattatgccatgaactgggtccnccaggctccgaggggagggctgggagtgggtagttcagttagagcatggcttangctgggacacgagaatacgccgtcgtctggtagaaaggcagattcatctatcctanaaganatgacttacaacggcatcgacctatctgcagatgaacacgacctagaacgaccgaaggacacacgtaccgtacttattaacgtgtaggttagggtagttttacgtagtttttaggtagg

SEQ ID NO: 353298 - DNA, 581 bp, Homo sapiens
  misc_feature: GZ8MTXP02F3S5E.4.33.C11.1.454.CMB.2.raw
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
  modified_base (474)..(474): a, c, t, g, unknown or other
  misc_feature (474)..(474): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctatttaaaggtgtccaatgtgaggtgcagctggtggagtcgtgggggaggcttggtccagccgaggggcggtccctgagactctcctgtacagcgtctggattcaactttcgtgattatgccatgaactgggtccncaggctccgaggggagggctggagtgggtaggtttcagttagagccagtggcttangctgggacacgagaaactacgccgcgtctgtagaaagcaagattcatcatctacaagagatgacttaccgaaacggcatccgaccttaatccgtagacaggaatgaaacgngcccgtaaggaaaacggaccggaacgggaaaccacgacggtacccttcttaacttaacgttggttacggtttaacgggtacgtttttacgtaggtttttaggtaagg

SEQ ID NO: 353299 - DNA, 553 bp, Homo sapiens
  misc_feature: GZ8MTXP02J16HZ.4.33.C11.1.454.CMB.2.raw
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccagggcggtccctgagactctcctgtacagcgtctggattcaactttcgngattatgccatgaactgggtcccnccaggctccgaggggagggctggagtgggtagtttcattagagccatggcttagcgcgtgggacaacagaatacgccgcgtctgtagaaaggcaagtattcatcatctacaagagatgattccgaacgcatccgcctatctgcagatgaacagcctagaacgaccgaggacacgtacgccgtactacttacgtcgttaggtttagggtaagttttacgtagtttttagggagttggtaattactttaaaccc

SEQ ID NO: 353300 - DNA, 536 bp, Homo sapiens
  misc_feature: GZ8MTXP02GK2H7.4.33.C11.1.454.CMB.2.raw
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaaggtgtccaatgtgaggtgcagctggtggagtcgtgggggagcttggtccagccagggcggtccctgagactctcctgtacagcgtctggattcaactttcgtgatttatgccatgaactgggtccncaggctccgagggaaggggctggagtgggtaggtttcattagagccatggcttangctgggacacgagaaatacgccgcgtctgtagaaagcagattcatcatctacaaagagatagattaccaaacggcatcgacctatcctgcagatgaacagcctagaacgaccgacggacacgacgccgtctattaacgtgtagttagggtagttttacgtagttttaggtaagg

SEQ ID NO: 353301 - DNA, 598 bp, Homo sapiens
  misc_feature: GZ8MTXP02FM96Q.4.33.C11.1.454.CMB.2.raw
  modified_base (306)..(306): a, c, t, g, unknown or other
  misc_feature (306)..(306): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcgtcctgagactctcctgtacagcgtctggattcaactttcgtgattatgccatgaaactgggtccnccaggctccgaggggaaggggctggagtggggtaggtttcattagagcatggctatgctgggacacagaaatacgccgngtctgtgaaaacggnaagatcatacatactacaagaagagtagtaacttaccgaaaccggacgtactaccgtacctaactacgtacgacgaagaagtaagaaacgaacgaccgtacgaaacggaaaccggaaacggaaacgaacgaacgaccgtactaacttaacgtagttacggttacgggttaggtttaacggtttaacgtttaggttagg

SEQ ID NO: 353302 - DNA, 628 bp, Homo sapiens
  misc_feature: GZ8MTXP02I4D3T.4.33.C11.1.454.CMB.2.raw
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
  modified_base (387)..(387): a, c, t, g, unknown or other
  misc_feature (387)..(387): n is a, c, g, or t
  modified_base (416)..(416): a, c, t, g, unknown or other
  misc_feature (416)..(416): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggagcttggtccagccgaggggccggtccctgagactctcctgtacngcgtctggattcaactttcgngattangccatgaactgggtccncaggctccgagggagggctggagtgggtagtttcagttagagccagtggcttatgctgggacacgagaaatccgccgngtctgtaggaaagcagattcatcatctanaagatatcgattacccgaaacggctacgtcccgtaccttaatcccgttagaccaagtaacttacggaaaccgaacgtcccgtaagggaaaaccggacccgggaaaggaacccgaacgtaaccgtacccggttacttaacgtttaaccgttaggtttacgggttttaacgggggttaaagtttttaccggtttaagttttttagggtaaaggg

SEQ ID NO: 353303 - DNA, 536 bp, Homo sapiens
  misc_feature: GZ8MTXP02GELVN.4.33.C11.1.454.CMB.2.raw
  modified_base (322)..(322): a, c, t, g, unknown or other
  misc_feature (322)..(322): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaacaatgaagaactacttagcttaggtatcagcaagaaaccaggacagcctacctaagctgctctattaccgggnacgctacccccgggatcccggggtcctgacgcgattcgagtggcaggccgggtctggggacagatttcactctcaccatcagcagcctgccgaggctagaagatggtagactagtttacttactgtacagactaattcttactactactccgtcggtaccgtttacggcggtaacggaaccgtaaaggtggaacgactacgaaacgtaacgtgg

SEQ ID NO: 353304 - DNA, 549 bp, Homo sapiens
  misc_feature: GZ8MTXP02FRDRS.4.33.C11.1.454.CMB.2.raw
  modified_base (308)..(308): a, c, t, g, unknown or other
  misc_feature (308)..(308): n is a, c, g, or t
  modified_base (406)..(406): a, c, t, g, unknown or other
  misc_feature (406)..(406): n is a, c, g, or t
  modified_base (471)..(471): a, c, t, g, unknown or other
  misc_feature (471)..(471): n is a, c, g, or t
  modified_base (503)..(503): a, c, t, g, unknown or other
  misc_feature (503)..(503): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttggcttagctgggttttccttgttgcttattttaaaaggtgtccaatgtgaggtgcagctggtggagtcgtgggggagcttggtccagccagggcggtccctgagactctcctgtacagcgtctggattcaactttcgtgatttatgccatgaactgggtcccncaggctccgaggggaagggctggagtgggtagtttcattagagccatggcttatgctgggaacacgagaataccgccgcgtctgtagaaagcagattnatcatctacaaagagatgtaacttcccaaacggcaatccgaccttaatccgtgacagatgaaacngcctagaacgaccgaggaaccacgacgccctntaattaacgtgtaggttagggtattttaacgtagttttaggtaagg

SEQ ID NO: 353305 - DNA, 556 bp, Homo sapiens
  misc_feature: GZ8MTXP02HTTWR.4.33.C11.1.454.CMB.2.raw
  modified_base (238)..(238): a, c, t, g, unknown or other
  misc_feature (238)..(238): n is a, c, g, or t
  modified_base (385)..(385): a, c, t, g, unknown or other
  misc_feature (385)..(385): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (527)..(527): a, c, t, g, unknown or other
  misc_feature (527)..(527): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccatcaactgcaagtccagccagagtgttanatacagctaccaacaatgaagaaactacttagcttggtatcagcaagaaaaccaggacacgcctacctaaagctgctacagtttaccgggcagccgtacccccggggaatcccggggtccctggacgcgattcagtcgcaggcggtntgggacagtattcactctacaccatcagcacgccngcaggctagaagngtggtaggctaagtttattacgtggtacagtactaattacttactactacctccgtacggtacgtttcggacgggaacgggaaccgtaaagggnggaacgaagtaccgaaaacgtaacgtggg

SEQ ID NO: 353306 - DNA, 529 bp, Homo sapiens
  misc_feature: GZ8MTXP02J0USD.4.33.C11.1.454.CMB.2.raw
  modified_base (353)..(353): a, c, t, g, unknown or other
  misc_feature (353)..(353): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaacttttcgtgattatgccatgaactgggtccgccaggctccagggaagggctggagtgggtagttcattagagcatggcttangctgggacaacgagaatacgccgctctgtgaaaggcagatcatcatctacaagagatgacttccaacggcatcgcctatctgcagatagaacagcctagaacgacgaggacacagccgtactattactgtagttagggtaagttttacgtagttttggagtggtattatttaaccc

SEQ ID NO: 353307 - DNA, 521 bp, Homo sapiens
  misc_feature: GZ8MTXP02FQKRB.4.33.C11.1.454.CMB.2.raw
  modified_base (360)..(360): a, c, t, g, unknown or other
  misc_feature (360)..(360): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctatttaaaggtgtccaatgtgaggtgcagctggtggagtctgggggagcttggtccagccagggcggtccctgagactctcctgtacagcgtctggattcaactttcgtgatttatgccatgaactgggtccgccaggctccgaggggaggggctggagtgggtagtttcattagagccatggcttangctggggacacagaatacgccgcgtctgtgaaaggcagattcatcatctacaagagatgattccaaacggcatcgcctatctgcagatgaacagcctagaagaccgaggacacacgccgtctaattcgtgtagttagggtagttttacgagttttggtaag

SEQ ID NO: 353308 - DNA, 626 bp, Homo sapiens
  misc_feature: GZ8MTXP02JI5QM.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaaacaatgaagaaactacttagcttggtatcagcaagaaaccaggacacgcctacctaagctgctctacgtttaccggcagccgtaacccccggggatcccggggtccctgacgcgattcagtggcgaggcgggtcgtggggacagtatttcacgtctacaccatcacgcacgcccgtgaccgaggtccgtaggaaacgtagttggtacggtaccgttaaggttttaacttacgtcggttaccaagtacctaaaatttactttaccttaccttaacccgttcccgttaccgggttacccgtttaccggggccggggtaaacggggtaaccgtaaacggggttaggaaacgtacgtaaacgaaaaccggtaacgtaggg

SEQ ID NO: 353309 - DNA, 523 bp, Homo sapiens
  misc_feature: GZ8MTXP02JX2LZ.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaacaatgaagaaactacttagcttggtatcagcaagaaaccaggacagcctctaagctgctcatttaccggcagctacccccgggatccggggtcctgagcgattcagtggcagcgggtctgggacagatttcactctcacatcagcagcctgaccgaggctagaagagtggtaggctaaggtttattaaccgtgtacagtactaattacttactactacctccgtacggtactttcggacggaggaaccgaggtagacgatacgaaacgaactgg

SEQ ID NO: 353310 - DNA, 667 bp, Homo sapiens
  misc_feature: GZ8MTXP02JEDDT.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggccaaccatcaactgcaagtccagccagagtgtatatacagctacaaacaatgaagaactacttagcttggtatcagcaagaaacaggacagcctacctaaagctagctacgaacgtttaccgggacaacggtccgtaaccccccggggtaaacgttcccgggggtacccctaggaacggccgtaagtttccgaagggttcgggaccgaagggtccgggggttactagggggaacctagtactttaccaactccgtaccaaccctaactaccgacgaccgacgccgtacgacgacggtacgtagtaagtagtaggtacggtacgttaagtttaacgttacgtacgtacgtaacgtaactaaacttaacttacttacctaccgtaccgtaccggtacgttacgggtacgggaacggtaacggtaacggtaacggtaacgaacgtaaacgtaaacgtaacgtacg

SEQ ID NO: 353311 - DNA, 601 bp, Homo sapiens
  misc_feature: GZ8MTXP02JQ0MN.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaacaatgaagaactacttagcttggtatcagcaagaaaccaggacagcctctaagctgctcagttaccggcagcctaccccgggatcccggggtcctgagcgattcgagtggcgagcgggtctgggacagtattcactctacaccatcagcacgcctgcgaggtctagaagagtggtacgtacgttaaggtttaacttacgttcgtacgtaacgtactaaaacttactttaccttaaccttaccgttacccgtacgggttacccgtttacccggggtaccggggtaacggggtaacccgtaagggggttaacggaacggtaacgtaaccggtaaaacggtaaccgtttacgggg

SEQ ID NO: 353312 - DNA, 556 bp, Homo sapiens
  misc_feature: GZ8MTXP02GZA6S.4.33.C11.1.454.CMB.2.raw
  modified_base (363)..(363): a, c, t, g, unknown or other
  misc_feature (363)..(363): n is a, c, g, or t
tcagagcactgtagcacgaccggtgctcgatttagagtgagctcgttgggtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccgagggaaggggctggagtgggtaggttcattagagccatggcttatgctgggacaacagaatacgccgcgtctgtgaaaggcagattcatcatctacaagagatgacttccaacggcatccgcctatctgcagatgaacngcctagaacgaccgagacacagccgtactattactgtgttagggtagttttacgtagttttggagttggtattattactaacccctatttcgactacgtgggtaccgacgggacctggtccgccgtctctcacgccctaccgaccgacggcccacgtccgtccgttccccgcggccgtccctcgcctcgacgg

SEQ ID NO: 353313 - DNA, 562 bp, Homo sapiens
  misc_feature: GZ8MTXP02JM95D.4.33.C11.1.454.CMB.2.raw
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
  modified_base (479)..(479): a, c, t, g, unknown or other
  misc_feature (479)..(479): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggcttggtcccagccgagggcggtccctgagactctcctgtacngcgtctggattcaactttcgngatttatgccatgaacgtgggtcccncaggctcgaggggagggctggagtgggtagtttcagttagacgcagtggcttangcgtagggacacgagataccgccgcgtactgtagaaagcagattcatacatctacgaagagatgtacttaccgaaacggctacgtccgccttatctcgacagtatagaacngacctaggaacgaccgacggaccacgacgtccgtactattaacgtggttacggttacgggtagttttacggtagttttaggag

SEQ ID NO: 353314 - DNA, 597 bp, Homo sapiens
  misc_feature: GZ8MTXP02G7DHF.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccagagtgttatatacagctaccaaacaatgaagaactacttagcttggtatcagcaagaaaccaggacacgcctactaagctgctacactttaccggggcacggtccgtaacccccggggaacgtccccggggtaccctggacgccggtattccgaaggtcgggacgtaggtccggggtcgtaggggaacagtatttccactctacaaccatcagcacgcctgacctaggactaggaagtagtggtaggacttaagtttacttaacgtgttacagtactaattacttctaacttcctaccgtacggtaccgttcgggacggacggtaaccgagggtaggacgtaacgtaacgaaaaccggtaagtcgg

SEQ ID NO: 353315 - DNA, 547 bp, Homo sapiens
  misc_feature: GZ8MTXP02I5W2F.4.33.C11.1.454.CMB.2.raw
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggagcttggtccagccagggcggtccctgagactctcctgtacagcgtctggattcaactttcgtgattatgccatgaactgggtccgccaggctccgaggggaaggggctggagtgggtaggtttcattagagccatggcttangctgggacaaacngaactcgccgcgtctgtagaaaggtcagtattcatcatctacaagagatgacttaccaacgcatccgacctatctgcagatagaacagacctagaacgaccgaggacacacgccgtactattactgtggtttagggtaagttttacgtagttttaggagttaggtattatttaaaccc

SEQ ID NO: 353316 - DNA, 489 bp, Homo sapiens
  misc_feature: GZ8MTXP02FZZ7Y.4.33.C11.1.454.CMB.2.raw
  modified_base (408)..(408): a, c, t, g, unknown or other
  misc_feature (408)..(408): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctctaagctgctcatttaccggcagctaccccgggatccggggtcctgagcgattcgagtggcagcgggtctgggacagattcactctcaccatcagcagcctgcagctgagatgnggcagttatactgtcagcaatcttactactctcctcggtactttcggcggaggtaaccgaggtgacgatacaacgactagg

SEQ ID NO: 353317 - DNA, 545 bp, Homo sapiens
  misc_feature: GZ8MTXP02HJE1C.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttcctgttgctatttaaagtgtccaatgtgaggtgcagctggtggagtcgtgggggagcttggtccagccagggcggtccctgagactctcctgtacagcgtctggattcaactttcgtgattatgccatgaacgtgggtccgccaggctccgaggggagggctggagttggggtagtttcagttagagccagtggctttagtgcgtaggggaacacgagaaactaccgccgcgtctgtaggaaaggcagtatcatcatctactaagagatagtacttaccgaacggctacgtcgcctaatcgtgctagatgaacagcctagaacgacgacgacacacgccgtactattaacgtgtagttaggtagtttacgtagttttaggtag

SEQ ID NO: 353318 - DNA, 530 bp, Homo sapiens
  misc_feature: GZ8MTXP02IA9ZN.4.33.C11.1.454.CMB.2.raw
  modified_base (303)..(303): a, c, t, g, unknown or other
  misc_feature (303)..(303): n is a, c, g, or t
  modified_base (408)..(408): a, c, t, g, unknown or other
  misc_feature (408)..(408): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccaggggcggtccctgagactctcctgtacagcgtctggattcaacttttcgtgattatgccatgaactgggtccnccaggctccgaggggagggctgggagtgggtagtttcagttgagcatggcttatgctgggaacaacagaatccgccgcgtctgtagaaaggcagatcatcatcanaagagatgattaccgaacgcatcgcctatctgcagatagacagcctagaacgacgagacacacgctactacttctgtgttaggtaagtttacgtagttttggagtaggtattacgtttaacc

SEQ ID NO: 353319 - DNA, 638 bp, Homo sapiens
  misc_feature: GZ8MTXP02IS83F.4.33.C11.1.454.CMB.2.raw
  modified_base (470)..(470): a, c, t, g, unknown or other
  misc_feature (470)..(470): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaaggtgtccaatgtgaggtgcagctgggtggagtcgtgggggaggcttggtccagccgaggggcggtccctgagacctctcctgtacagcgtctggtattcaactttcgtgattatgcccatgaaccgtggggtcccgccgacggcctccggaagggggacggggctaggggagggttggggttaggtttcaagttagacgtcctagtggtactttagtcggtacgtacgggaacacgagtaaactaccggcccgtcgtctagggtagaaagggcagattcatcatcctanaagagatagtacttacccgaaaggctatccgactactcgtagacagaactagaacacgaccgtacgaaacggaccggacgaaccacgtacggtaccttacttaacgttaacggttaggtttacggtttaacgggttacgtttttaacggtttagtttttaaggtacgg

SEQ ID NO: 353320 - DNA, 494 bp, Homo sapiens
  misc_feature: GZ8MTXP02FKALD.4.33.C11.1.454.CMB.2.raw
  modified_base (312)..(312): a, c, t, g, unknown or other
  misc_feature (312)..(312): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaacaggacagcctctaagctgctcattaccggnagctacccccgggaatccggggtcctgagcgattcagtggcagcggtctgggacagattcactctcaccatcagcagctgcagctgaagatgtgctagttattactgtcagacaatacttcacttactcctcggtactttcggcggtacggaaccgaaggtaggagatacgaaacgaactgg

SEQ ID NO: 353321 - DNA, 538 bp, Homo sapiens
  misc_feature: GZ8MTXP02F479G.4.33.C11.1.454.CMB.2.raw
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (457)..(457): a, c, t, g, unknown or other
  misc_feature (457)..(457): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggagcttggtccagccagggcggtccctgagactctcctgtacagcgtctggattcaactttcgtgattatgccatgaactgggtccncaggctccgagggagggctggagtgggtagtttcattaganccatggcttangctgggaacacagaaatacgccgcgtctgtagaaaggcagattcatcatctacaagagatgattacccaacggcatccgcctatcctgcagatgaaacngcctagaacgaccgacggacacacgccgtctaattcgttggttaggttacggggtagtttttacgtagtttttaggtaagg

SEQ ID NO: 353322 - DNA, 525 bp, Homo sapiens
  misc_feature: GZ8MTXP02IU28D.4.33.C11.1.454.CMB.2.raw
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggagcttggtccagccagggcgtccctgagactctcctgtacagcgtctggattcaactttcgngattatgccatgaactgggtccncaggctccgaggggagggctgggagtgggtagttcagttagagccatggcttatgctgggacagagaatcgccgcgtctgtagaaagcagattcatcatctacaagagatagacttaccgaaacggcatccgcctatctgacagatagaacagcctagaacgacgagacacacgaccgtatataacgtgtagttacggtagtttacgtagttttaggtag

SEQ ID NO: 353323 - DNA, 584 bp, Homo sapiens
  misc_feature: GZ8MTXP02HELCJ.4.33.C11.1.454.CMB.2.raw
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (397)..(397): a, c, t, g, unknown or other
  misc_feature (397)..(397): n is a, c, g, or t
  modified_base (474)..(474): a, c, t, g, unknown or other
  misc_feature (474)..(474): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctgggtggagtcgtgggggagcttggtccagccagggccgtccctgagactctcctgtacagcgtctggattcaactttcgngatttatgccatgaactgggtcccncgaggctccgaggggagggctggaggtgggtagtttcagttagagccagtggcttagtgctaggggacacgagaaactacggccgngtctggtagaaagtcaagtattcaatcatctacaaagagatgaattacccgaaacggctaacgtccgaccctttaancgtagacaagactacgaaacacgaccgtaagaacggacgtaacgacacgacgtaccgttactaacgttaacgtggttacggtttacggttagtttacgttagtttaggag

SEQ ID NO: 353324 - DNA, 575 bp, Homo sapiens
  misc_feature: GZ8MTXP02HEH7J.4.33.C11.1.454.CMB.2.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (361)..(361): a, c, t, g, unknown or other
  misc_feature (361)..(361): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggagcttggtccagccagggcggtccctgagactctcctgtacagcgtctggattcaacgtttcgngatttatgccatgaactgggtccncaggctccgaggggaggctggagtgggtagttcagttagagcagtggcttagngcgtgggaacacgagaaactaccgccgcgtactgtagaaaggcaagattcatnatcctanaaagngatagtaacttacccgaaacggctaactcccgacttactcctagacagactacggaaacacgaccctaggaaacggacccggtaaggaaccacgtacgcccgttatagttaacgtgtaggttacgggtaatttacgtagttttaggagg

SEQ ID NO: 353325 - DNA, 554 bp, Homo sapiens
  misc_feature: GZ8MTXP02GCKV3.4.33.C11.1.454.CMB.2.raw
  modified_base (182)..(182): a, c, t, g, unknown or other
  misc_feature (182)..(182): n is a, c, g, or t
  modified_base (304)..(304): a, c, t, g, unknown or other
  misc_feature (304)..(304): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttcctgttgctatttaaaggtntccaatgtgaggtgcagctggtggagtcgtgggggagcttggtccagccgagggcgtccctgagactctcctgtacagcgtctggattcaactttcgtgatttatgccatgaactgggtccnccaggctccgaggggaggggctgggagtgggtaggtttcagttagagcatggcttatgctgggaacacgagaataccgccgagtctggtagaaaggcagattcatccatctacaagagatgattccgaaaggcatccgctatctgcagatgaacagacctaggaaacgaccggaacggaaccacgacgtccgtacttacgttaacgtggttaggtttaggggttacttttacggtagtttttaggtaagg

SEQ ID NO: 353326 - DNA, 580 bp, Homo sapiens
  misc_feature: GZ8MTXP02FUQW3.4.33.C11.1.454.CMB.2.raw
  modified_base (259)..(259): a, c, t, g, unknown or other
  misc_feature (259)..(259): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
tcagagcactgtagcacgaccggtgctcgatttagagtgagctcgttgggtttgggggagtgtgagggacatgagtggtagaaacagtggatatgtgtggcagtgtctgaccttggttgttttttgttgtaggtgtccaatgtgaggtgcagctggtggagtcgtgggggaggcttggtccagccaggggcggtccctgagactctcctgtacagcgtctggattcaacttttcgtgattatgccatgaactgggtccncaggctcgagggagggctggagtggtagttcattagagcagtggctttangcgtagggaacaaanagaataccggccgcgtctggtagaaacggcaagtattcatcatctacaaagagtatgtaacttccgaaacggcatccgctatctgacagatagaacacgcctagaaacgaccgagacacgacgccgtactattacgtgttaggttaggtagttttagtagttttaggagttagtacttaagttacctaaaccccttagtttacgaacgtaacggtcggggtaccgtaacgggtacccgtcggtaccgtccgttacc

SEQ ID NO: 353327 - DNA, 737 bp, Homo sapiens
  misc_feature: GZ8MTXP02I58G0.4.33.C11.1.454.CMB.2.raw
tcagagcactgtagcacgaccggtgctcgatttagagtgagctcgttggggtttgggggggagaggagccccagccgtgagattcccaggagtttccacttggtgatcagcactgaacacagaccaccaaccatggagtttgggcttagctgggttttccttgttgcttattttaaaaggtgtccaatgtgaggtgcagctgggtggagtcgtggggggaggcttggtccaggcccgaggggccggtccctgacgactctcctgtacagcgtctggattctaactttcgtagtattatcgccagtcgaacgttcggggtcccgccgaggcctaccggagggggaacggggctaggggaggttggggttaggtttcaagtttacggacgtcctagttgggtactttagcggtcgtaggggaacaaacgagaaacgtccgccggtcgttcgtaggtagaaaaggctaagtacttacatacatactacgaaagagtattacggtaacttacccgaaacgggtcctacgttcccggtaccttaacttccgtacggaccgtaagtagtaacgaaaccgtacggtacccgtaagggaaaaccggacccgggaaacggaacccgaccgtaccgggtacccgttaactttaaacgttacgttacgggtttagggtttaaaggggttaacgtttttacggtttagtttttagggaggtttaggttaactttaacgtttaaaccccg

SEQ ID NO: 353328 - DNA, 544 bp, Homo sapiens
  misc_feature: GZ8MTXP02HGP9W.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaaacaatgaagaactacttagcttggtatcagcaagaaaccaggacagcctactaagctgctcagtttaccgggcacgccgtacccccggggaatcccggggtccctgacgcgattccgagtggcaggcgggtcgtggggacagtattcactctacaccatcagcagcctgacaggctagaagatggtgactagtttatacgtgtacagtactaattactactactaccttccgtacggtacgttcgggacggaacggaacgaagggtacgacggactaccgaaaacgtacgtagg

SEQ ID NO: 353329 - DNA, 534 bp, Homo sapiens
  misc_feature: GZ8MTXP02JPCCC.4.33.C11.1.454.CMB.2.raw
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaacaatgaagaactactagcttggtatcagcagaaaccaggacagcctactaagctgctcacgtttaccgggcacgccgtacccccggggaactcccggggtcctggacgcgtatcgaggtcggcaggccgggtctggggacagtattcgactcncaccatcacgcagcctgacnggctagaagagtgtgtacgtagtttattactgtcagtacaattactactactacctcgtcggtacgttcggacggaggaacgaaggtcgtacgatacgaaacgacgtacgg

SEQ ID NO: 353330 - DNA, 675 bp, Homo sapiens
  misc_feature: GZ8MTXP02IZAZU.4.33.C11.1.454.CMB.2.raw
  modified_base (304)..(304): a, c, t, g, unknown or other
  misc_feature (304)..(304): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttcctgttgctatttaaaggtgtccaatgtgaggtgcagctggtggagtcgtgggggagcttggtccagccagggcgtccctgagactctcctgtacagcgtctggattcaactttcgtgatttatgccatgaactgggtccncgaggcctaccgaggggagggcgtggaggtggggttaggtttcagttagagcctagtggctttagcgcgtaggggaacaacgagaaactaccggcccgtcgtctggtaggaaagggcaggtacttcatcattcctacgaaagagatgtaacttacccgaaacggctaagtcccggtaccttaactcgtacgacaaggtaattacggaaaacgccggtaccctaaggggaaaacggaaaccccgggaacgggaaacctaaaccgaccgggttaaccccgttacgttaaacgtttaaccgttggggtttaacggggttttaaacgggggtttagttttttaaaccgggtttaggttttttacggggtaaaggg

SEQ ID NO: 353331 - DNA, 536 bp, Homo sapiens
  misc_feature: GZ8MTXP02HKXFA.4.33.C11.1.454.CMB.2.raw
  modified_base (282)..(282): a, c, t, g, unknown or other
  misc_feature (282)..(282): n is a, c, g, or t
  modified_base (349)..(349): a, c, t, g, unknown or other
  misc_feature (349)..(349): n is a, c, g, or t
  modified_base (387)..(387): a, c, t, g, unknown or other
  misc_feature (387)..(387): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttcctgttgctattttaaaggtgtccaatgtgaggtgcagctggtggagtcgtgggggagcttggtccagccagggcggtccctgagacctctcctgtacagcgtctggattcaactttcgngattatgccatgaactgggtcccgccaggctccgaggggaagggctggagtgggtagtttcattagngccatggcttagtgctggggacacgagaaatacgccgngtctgtagaaagcagatcatcatctacaagagatgattccaacggcatcgcctatctgcagatgaacagcctagaacgaccgaggacacgacgccgtactacttaacgtgttacggttagggtagttttacggtagtttttaggtaagg

SEQ ID NO: 353332 - DNA, 584 bp, Homo sapiens
  misc_feature: GZ8MTXP02JJZUO.4.33.C11.1.454.CMB.2.raw
  modified_base (472)..(472): a, c, t, g, unknown or other
  misc_feature (472)..(472): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggcccacatccaactgacaagtccagccagagtgttatatacagctaccaaacaatgaagaactacttagcttaggtatcagacaagaaaccgaggacacgcctactaagctgctacacgttaccggcacggccgtaacccccgggagtcccggggtcctggacgcgtattcgagtggacgaggcgggtcgtgggacagtacttcactctacaccatcagcacgcctagcaggctagaagagtcggtagtacgtagtttactacgtcgtntacgtactaattacttaccttaactacccttccgtaccggttaccgttacgggacgggtaacgggaaccgtaagggtaggaacgtaacgtaacgaaaaccggtacgttcggg

SEQ ID NO: 353333 - DNA, 655 bp, Homo sapiens
  misc_feature: GZ8MTXP02HKKHV.4.33.C11.1.454.CMB.2.raw
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtggggggagcttggtccagccagggccgtccctgagactctcctgtacagcgtctggattcaactttcgtgattatgcctatcgaacgtcggggtcccgccgaggcctccggagggggaacggggtctggggtaggttggggttaggtttcagttaggacgtccagtggtctttagtcgtcgtaggggaacaaacgagaaacttccggccgtcgttacgtaggtagaaagggtcaagtacttacatctatactacaaagagtatagtaacttacccgaaacggtctaacgtccgtaccttacttcgtcgacgtaagtactacggaaactacgaccgtaaggaaacgaccggaacggaaccacgacgtccgtacttacgttacgtaggttagggttaggttaagtttagttagttttaggagttacggtaactttacgtttaaaccc

SEQ ID NO: 353334 - DNA, 549 bp, Homo sapiens
  misc_feature: GZ8MTXP02IU9WU.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcaagaaaccaggacagcctctaagctgctcatttaccgggcagcctaccccgggaatcccggggtcctgagcgattcgagtggcagcgggtctgggacagatttcactctcaccatcagcagcctgcaggctagaagatggtaggctaggtttattacgtgttacagtactaaattacttctaacttaaccttcccgttacgggtacctttcggggaccggtaacgggtaaccgaaagggttacggaacgacttacgaaaacggaacttcggg

SEQ ID NO: 353335 - DNA, 526 bp, Homo sapiens
  misc_feature: GZ8MTXP02FV3Y5.4.33.C11.1.454.CMB.2.raw
  modified_base (316)..(316): a, c, t, g, unknown or other
  misc_feature (316)..(316): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaaacaatgagaactactagcttggtatcagcagaaaccaggacagcctcctaagctgctcatttaccgggnagctacccccgggaatccggggtccctgagcgattcagtggcagcgggtctggggacagtatttcactctcaccatcagcagcctgcaggctgaaagntgtgntagtttatactgtacagctaatacttctacttacgtcccttcggtacctttcggggacggaggggtaacccgaaagggtcggaacggtatacaaaacgaaccgttgg

SEQ ID NO: 353336 - DNA, 566 bp, Homo sapiens
  misc_feature: GZ8MTXP02JN8CQ.4.33.C11.1.454.CMB.2.raw
  modified_base (324)..(324): a, c, t, g, unknown or other
  misc_feature (324)..(324): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaaacaatgaagaaactacttagcttggtatcagcaagaaaccaggacagccctactaagctgctctagttaccgggnacggcctacccccggggaatcccggggtccctgagcgatcagtggcaggcgggtctgggacagtattcactctacaccatcagcacgcctgcaggctaggagacgtgtaggacttagtttactacgtgtacagactaattacttacttaacctctcccgttacggtaccgtttacggggcggtaaacggggaaccgtaaacgggttaggaacggtaactaaccgtaaaaccggtagttacgg

SEQ ID NO: 353337 - DNA, 523 bp, Homo sapiens
  misc_feature: GZ8MTXP02FLGOY.4.33.C11.1.454.CMB.2.raw
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctatttaaaaggtgtccaatgtgaggtgcagctggtggagtctgggggaggcttggtccagccaggggcggtccctgagactctcctgtacagcgtctggattcaactttcgtgattatgccatgaactgggtccncaggctccgaggggagggctgggagtgggtaggtttcagttagagccatggcttangctggggacacagaataccgccgcgtctgtagaaaggcagattcatcatctacaaagagatgattccaaacggcatcgcctatcctgcagatgaacagcctagaacgaccgagacacacgccgtatataacgtgtagttagggattttacgattttggag

SEQ ID NO: 353338 - DNA, 717 bp, Homo sapiens
  misc_feature: GZ8MTXP02IWOBZ.4.33.C11.1.454.CMB.2.raw
  modified_base (258)..(258): a, c, t, g, unknown or other
  misc_feature (258)..(258): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagtgttatatacagctaccaaacatgaanaactacttagcttaggatcagacaagaaaccaggacacgccctacctaagctagcctacgtacgtttacccggggcaacggtcccgtaacccccggggtaacgtccccggggtccctaggacgccgtacttcggaggtcggcgagggtccggggtcgagggggtaactagtactttccgaaccttcctacccaaccctagttaccgaacgcccgtaacgccgtacggaccgaacgggtaccgtaaggaaagtagttcgggttacggtaccgttaaggttttaacttacgtacggttacaaacgtacttaaaacgtttacctttaccttaaacccttacccgttaccccgttaaccgggttacccgggtttaccgggaaccgggggtaacgggtaaaacccggtaaaggggttacggtaaaacggtaaacgttaaccggaaaaaccggtacgttacgggg

SEQ ID NO: 353339 - DNA, 532 bp, Homo sapiens
  misc_feature: GZ8MTXP02JT77N.4.33.C11.1.454.CMB.2.raw
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (408)..(408): a, c, t, g, unknown or other
  misc_feature (408)..(408): n is a, c, g, or t
  modified_base (494)..(494): a, c, t, g, unknown or other
  misc_feature (494)..(494): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggcttggtccagccagggcgtcctgagactctcctgtacagcgtctggattcaactttcgtgatttatgccatgaacgtgggtccnccaggctccgaggggagggctggagtgggtagtttcattagncatgcttangctggacagagaatacgccgngtctgtagaaagcagatcatcatctanaagagatagattaccgaaacggtcagtccgtacctatcctgacagactagaacacgcctagaacgacgacggacacgtacgccgtntataacgtgtagttaggtagtttacgtagttttggaag

SEQ ID NO: 353340 - DNA, 599 bp, Homo sapiens
  misc_feature: GZ8MTXP02ITUM1.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttatatacagctccaaacaatgaagaaactacttagcttggtatcaagcaagaaaccaggacagccctactaagctgctctacgtttaccgggcagccgtacccccggggaacgtcccggggtccctggacgcgtattcgagtcggcaggtcggggtctgggacagtattcactctcaacatcagcacgcctgcgaggctagaagagtgtaggcttaaggtttactaacgtggtacagtactaaatttacgttacctaaaccttaccgtacccgttacggtaaccgtttccggggacgggtaacggggtaacccgtaaacgggggtaggaaacggtaactaaccggtaaaaccggtaacgtcggg

SEQ ID NO: 353341 - DNA, 584 bp, Homo sapiens
  misc_feature: GZ8MTXP02IA8XX.4.33.C11.1.454.CMB.2.raw
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (420)..(420): a, c, t, g, unknown or other
  misc_feature (420)..(420): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtgagtcgtgggggagcttggtccagccagggcgtccctgagactctcctgtacagcgtctggattcaacttttcgngtattatgccatgaactgggtccncaggctccgaggggagggctggagtgggtagttcattagngccagtggcttatcgcgtagggaacaaacgagaaactaccggccgtcgttctaggtagaaaggcaagtatcatcatctanaagagatagaacttaccgaacgacacgtccgtacctattctgacagaagaacgaacacgacgtaaggaacgaaccggaacgaacacgacgtaccgttactaacgttacgtggtttaggttaaggttaagtttagttagttttaggagttagtaacttactaacc

SEQ ID NO: 353342 - DNA, 542 bp, Homo sapiens
  misc_feature: GZ8MTXP02IYUZP.4.33.C11.1.454.CMB.2.raw
  modified_base (427)..(427): a, c, t, g, unknown or other
  misc_feature (427)..(427): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaaacaatgaagaactacttagcttggtatcagcaagaaaccaggacagcctctaagctgctcacgttaccgggcacggcctacccccggggatcccggggtcctggacgcgtattcgaggtggcaggcgggtcaggggacagtatttcactctcaccatcagcagcctgcaggctgaagngtgtaggactagtttactacgtgtacagactaattacttctaactacctccgtacggtacgtttcgggacggtagggaaccgtaagggtcggaagacgtacgaaaacgtactcgg

SEQ ID NO: 353343 - DNA, 548 bp, Homo sapiens
  misc_feature: GZ8MTXP02JEBFI.4.33.C11.1.454.CMB.2.raw
  modified_base (285)..(285): a, c, t, g, unknown or other
  misc_feature (285)..(285): n is a, c, g, or t
  modified_base (427)..(427): a, c, t, g, unknown or other
  misc_feature (427)..(427): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccaggggcggtccctgagactctcctgtacagcgtctggattcaactttcgngattatgccatgaactgggtcccgccaggctccgaggggaagggctggagtggggtaggtttcattagagccagtggcttatgctaggggacacgagaatacggccgcgtctggtagaaagcagattcatcatctacaaganatgtattaccaacggctactcgtcctatctgcagactgaacagcctagaacgacgacggacaactacgacccgtcgtaattaacgtgtaggttagggtagttttacgtatttttagggagg

SEQ ID NO: 353344 - DNA, 534 bp, Homo sapiens
  misc_feature: GZ8MTXP02HNENZ.4.33.C11.1.454.CMB.2.raw
  modified_base (287)..(287): a, c, t, g, unknown or other
  misc_feature (287)..(287): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaacaatgagaactacttagcttggtatcagcaagaaaccnggacagcctacctaagctgctctagtttaccgggcacgccgtacccccggggaactcccggggtccctgagcgattcgagtgcgagcgggtcgtgggacagtattcactctcaccatcagcacgcctgcgagctagaagatggtggactagtttatactgtacagtactaattacttactactactccgtacggtacgttcggacggacggaaccgaaggtacggagacgtacgaaaacgtacgtgg

SEQ ID NO: 353345 - DNA, 547 bp, Homo sapiens
  misc_feature: GZ8MTXP02JIJP5.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctactaagctgctcagttaccgggcagcctaccccgggatcccggggtcctgagcgattcgagtcggcaggcggggtcgtggggacagtatttcactctacaccatcagcacgcctgacaggctagaagatggtgactagtttattacgtgtacagtactaatacttactacctacctccgtaccggttacgtttaccgggcgggtaacgggaaccgtaaagggtaggacgacgtaacgaaaacgtaacgttagg

SEQ ID NO: 353346 - DNA, 549 bp, Homo sapiens
  misc_feature: GZ8MTXP02IMUTP.4.33.C11.1.454.CMB.2.raw
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (387)..(387): a, c, t, g, unknown or other
  misc_feature (387)..(387): n is a, c, g, or t
  modified_base (404)..(404): a, c, t, g, unknown or other
  misc_feature (404)..(404): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtgggggaggcttggtccagccaggggcggtccctgagactctcctgtacngcgtctggattcaactttcgngtattatgccatgaactgggtccncatgctcgagggagggctgggagtgggtagttcattagngcccagtgcttangctgggacaacagaataccgccgngtctgagaagcagattnatcatctacaagagatagacttaccgaacggcagtccgacctatctgacagatagaactcgacctaggaaacgacccggaaggacctacacggcccttataagttacgtggttagttaggggtacgtttttacgagtttttaggg

SEQ ID NO: 353347 - DNA, 698 bp, Homo sapiens
  misc_feature: GZ8MTXP02HKDC6.4.33.C11.1.454.CMB.2.raw
  modified_base (281)..(281): a, c, t, g, unknown or other
  misc_feature (281)..(281): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttcctgttgctattttaaaggtgtccaatgtgaggtgcagctggtggagtcgtgggggagcttggtccagccgagggcggtccctgagctctcctgtacagcgtctggattcaactttcgngtattatgccatgaacgtgggtccgccgaggcctccgaaggggagggtcgtgggaggttggggtagtttcagtttagacgtccagtgggactttagtggcgttaggggaactaacgaagaaacgtacccggcccggtaccggttctgggttaaggaaaacggggtcaaaggtacttactaacttactaacttccttaagaaaagtaaggtaatagtaaaccgtttacccgaaaacgggtctaacgttacccgtaccttaactcccgttgaccgagtaacgttacgaaacgacgaccccgtaaggaaaaccgggaaccggaaacgggaaaccaaccgacgtacccgttacttaacgttaaccgttggttagggtttaacggggttacgtttttaacggttaggttttttagggtaagg

SEQ ID NO: 353348 - DNA, 551 bp, Homo sapiens
  misc_feature: GZ8MTXP02FY6AM.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttatatacagctccaacaatgaagaactacttagcttaggatcagcaagaaaccaggacagcctactaagctgctcacgttaccgggcacgcctacccccggggaatcccggggtcctggacgcgattcgagtcggcaggcgggtctggggacagtattcactctcaccatcagcagcctgcaggctaggaagagtggtgactagtttatacgtgacagtactaattacttactactacctaccgtacggtaccgtttacgggacgggtaacgggaaccgtaaagggtacggtaagacgtaacgaaaacggacgtacgg

SEQ ID NO: 353349 - DNA, 527 bp, Homo sapiens
  misc_feature: GZ8MTXP02IJ49D.4.33.C11.1.454.CMB.2.raw
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (490)..(490): a, c, t, g, unknown or other
  misc_feature (490)..(490): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgtgctattttaaaaggtgtccaatgtgaggtgcagctggtggagtctgggggagcttggtccagccagggcgtccctgagactctcctgtacagcgtctggattcaactttcgtgattatgccatgaactgggtccncgaggctcgagggagggctggagtgggtagttcattagagccatggcttagngctgggaacacgagaatacggccgcgtctgtagaaaggcagatcatcatctacaagagatgaattccgaaacggcaacgtcgcctatcctgacagatagaacagcctagaacgacgacggactacacgaccctntataactgtagttacggtagtttacgtatttaggtag

SEQ ID NO: 353350 - DNA, 552 bp, Homo sapiens
  misc_feature: GZ8MTXP02JMICZ.4.33.C11.1.454.CMB.2.raw
  modified_base (310)..(310): a, c, t, g, unknown or other
  misc_feature (310)..(310): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (457)..(457): a, c, t, g, unknown or other
  misc_feature (457)..(457): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcgtccctgagactctcctgtacagcgtctggattcaactttcgtgatttatgccatgaacgtgggtcccncgaggctccgaggggagggctaggaggtggtagtttcagttagngcagtggacttagngctgggaacagagaatacgccgngtntgagaaagcagattcatcatcctagaagagatagacttccgaaacggcacgtcgacctatcgngacgagatacgaacgacgacgaacggaacgacggacgacacgacgtaccgtatattcgtggttacggttaggttagtttacgttagtttaggacg

SEQ ID NO: 353351 - DNA, 614 bp, Homo sapiens
  misc_feature: GZ8MTXP02HI356.4.33.C11.1.454.CMB.2.raw
  modified_base (279)..(279): a, c, t, g, unknown or other
  misc_feature (279)..(279): n is a, c, g, or t
  modified_base (358)..(358): a, c, t, g, unknown or other
  misc_feature (358)..(358): n is a, c, g, or t
  modified_base (383)..(383): a, c, t, g, unknown or other
  misc_feature (383)..(383): n is a, c, g, or t
  modified_base (417)..(417): a, c, t, g, unknown or other
  misc_feature (417)..(417): n is a, c, g, or t
  modified_base (464)..(464): a, c, t, g, unknown or other
  misc_feature (464)..(464): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagcttgggttttccttgttgcttaattttaaaaggtgtccaatgtgaggtgcagctggtggagtcgtgggggagcttggtccagccagggcgtccctgagactctcctgtacagcgtctggattcaactttcgngattatgccatgaacgtgggtccgccaggctccgaaggggaagggctggagtgggtagttcattagagccatggcttangctgggaacaaacagaatacgccgngtctgtagaaaagcaagtacttcatcaatcctanaaagagatgaacttacccgaaacggtcaaattccgaccttaattccnggacaagagagaacaacgaccgtacgaaacgaaaccggaacggaacgaacgaacgaccgtaccgttaacttaccgttacgttaggttaagggttaaggtttaacggtttaagttttaggttaggttacggtaagttaactttaaaacccg

SEQ ID NO: 353352 - DNA, 568 bp, Homo sapiens
  misc_feature: GZ8MTXP02FYN5P.4.33.C11.1.454.CMB.2.raw
  modified_base (365)..(365): a, c, t, g, unknown or other
  misc_feature (365)..(365): n is a, c, g, or t
  modified_base (471)..(471): a, c, t, g, unknown or other
  misc_feature (471)..(471): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttggcttagctgggtttccttgttgctatttaaaggtgtccaatgtgaggtgcagctggtggagtcgtgggggaggcttggtccagccagggcggtccctgagactctcctgtacagcgtctggattcaactttcgtgattatgccatgaacgtgggtcccgccaggcctccgaggggaaggggctgggagtgggtaggtttcagttagagccatggcttangctgggaacacgagaactacgccgtcgtctggtagaaaggcagtatcatcatctacaaagagatagattccaaacggcaatccgactatcctgcagactagaaacngacctaggaacgaacccggaggaaccaacgacgtaccgtcttaataaccgttggtacggtttacggggtagtttttaacggtagtttttaggtaagg

SEQ ID NO: 353353 - DNA, 534 bp, Homo sapiens
  misc_feature: GZ8MTXP02F3ZNT.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaacaatgaagaactacttagcttggtatcagcaagaaaccagacagcctactaagctgctcatttaccggcagctaccccgggaactccggggtcctgagcgattcagtggcagcgggtctgggacagtatttcactctcaccatcagcagccctgactaggctagaagtactggtgactagtttaatacgtgtcagactaattacttactactacttccgtacggtaccgtttcgggcggtacgggtaaccgaagggtacggagtagtacgaaaacgtacgtacgg

SEQ ID NO: 353354 - DNA, 531 bp, Homo sapiens
  misc_feature: GZ8MTXP02JFM8Z.4.33.C11.1.454.CMB.2.raw
  modified_base (465)..(465): a, c, t, g, unknown or other
  misc_feature (465)..(465): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccataaactgcaagtccagccagagtgttatatacagctaccaacaatgagaactactagcttggtatcagcaagaaaccaggacagcctactaagctgcctcagtttacccgggcacgccgtacccgggaacgtccccggggtccctgacgcgattcgagtggacgagcgggtctaggggacagtacttcgactcgtcacatcagcacgctgcgtaggctagaagatggtggtactagtttatactgtcagctaaatnttactactactccgtacgtcttcgggacgaggaccgaaggtgagactacgaaacgtacgtgtacgg

SEQ ID NO: 353355 - DNA, 564 bp, Homo sapiens
  misc_feature: GZ8MTXP02FME4E.4.33.C11.1.454.CMB.2.raw
  modified_base (310)..(310): a, c, t, g, unknown or other
  misc_feature (310)..(310): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtcccagccaggggcggtccctgagactctcctgtacagcgtctggattcaactttcgtgattatgccatgaactgggtccncaggctcgagggagggctggagtgggtagtttcagttagagcagtggcttagtgctgggaacacgagaactacgccgcgtctgtagaaagcagtatcatcatctacaagagatgacttccgaaacggcagtcgacctatcctgacagatagaacacgacctaggaaacgaccggaacggaaccacgacgtacccgttattaacttaacgttggttaggtttaggggtagtttttacgtagtttttacggtaagg

SEQ ID NO: 353356 - DNA, 585 bp, Homo sapiens
  misc_feature: GZ8MTXP02HZKIP.4.33.C11.1.454.CMB.2.raw
  modified_base (472)..(472): a, c, t, g, unknown or other
  misc_feature (472)..(472): n is a, c, g, or t
  modified_base (497)..(497): a, c, t, g, unknown or other
  misc_feature (497)..(497): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctcagactccctggctgtgtctcgtgggcgagagggccaccatcaactgacaagtccagccagagtgttatatacagctaccaacaatgaagaactacttagcttaggtatcagacaagaaaccgaggaacaacgcctacctaaagcctgccttactaacgtttacccggggacaggtccgtaacccccggggaacgttccccggggtccctggacgcgtaattcgaggtcggcgagggtcgggtcgtaggggacagtactttcactctacaaccctatccagcacgcctgacgaggctaggaaagngtggtcggtattaagtttattacgngtacagtactaattacttctaactctccgtcggtacgttcggacggacggaaccgaagggtacgacgtaagaccgtaaagtaacgtgg

SEQ ID NO: 353357 - DNA, 588 bp, Homo sapiens
  misc_feature: GZ8MTXP02GFY66.4.33.C11.1.454.CMB.2.raw
  modified_base (249)..(249): a, c, t, g, unknown or other
  misc_feature (249)..(249): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctccaanaatgaagaactacttagcttggtatcagcaagaaaccaggacagcctactaagctgctctacgtttaccgggcacgccgtaaccccggggaacgtcccggggtccctgacgcgattcgagtggcagcgggtgtgggacagtattcactctcacatcagcagcctgaccgaggctaggaagagtggtggacttagtttaattacgtagtacgaatactaaattacttcctaaaccttaccttacccgtacggttaaccgtttccggggaccgggtaacggggtaacccgtaaaggggttaggaaacggtaacgtaacccgtaaaacggtacgttacgggg

SEQ ID NO: 353358 - DNA, 584 bp, Homo sapiens
  misc_feature: GZ8MTXP02I34B1.4.33.C11.1.454.CMB.2.raw
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtctgggggagcttggtccagccagggcggtccctgagactctcctgtacagcgtctggattcaactttcgtgattatgccatgaactgggtccnccaggctccgagggagggctggagtgggtagttcattagagccagtggcttagngctgggacacagaatacgccgcgtctgtagaaagcagattcatcatctacaaagagatgtaactttacccgaaacgggctaacgtcccgaccttaatcctaggacaggactagaaacacgacctaggaaaacgacccggaaggaaccaacgacgaccgttacttaacgttaaccgttaggttacggtttaacggggtagtttttaacgttagtttttaggtaagg

SEQ ID NO: 353359 - DNA, 631 bp, Homo sapiens
  misc_feature: GZ8MTXP02GY0R2.4.33.C11.1.454.CMB.2.raw
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccgagggcggtccctgagactctcctgtacagcgtctggattcaactttcgngattangccatgaactgggtccnccgaggctccgagggagggctgggagtgggtagtttcagttagagccagtggtcttagtgcgtaggggaacacgagaataccggccgcgtctgtagaaagcaagtatacatcatctacgaaagagtatggtaacttaccgaaacggctagtccgaccttaagtccgtacgacgtaagacgtacgaaacgtacgacccgtaaggaaaaccggaaccggaaacgggaaacccaaccgaccgtacccggttacttaacgttaaccgttaggttagggtttaaacggggttaaggtttttaaccgtttaggtttttaggtaaaggg

SEQ ID NO: 353360 - DNA, 587 bp, Homo sapiens
  misc_feature: GZ8MTXP02GO5TC.4.33.C11.1.454.CMB.2.raw
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
tcagagcactgtagcacgaccggtgctcgatttagagtgagctcgttgggtttggggagctctgggagaggagccccagccatgagattcccaggagtttccacttggtgatcagcactgaacacagaccaccaaccatggagtttgggcttagctgggttttccttgttgctattttaaaaggtgtccaatgtgaggtgcagctggtggagtctgggggagcttggtccagccagggcggtccctgagactctcctgtacagcgtctggattcaactttcgtgattatgccatgaactgggtccgccaggctccagggaaggggctgggagtgggtaggtttcattagagccccatggntatgngnggngaacaagaanacgccgcgtctgtagaaggagagatanatacatactacaaagaagaatagtattacctaacggacgactacgtacctactactcgcgacgaatagaaacgaacgaccgtacgaaacgaaaccggaaacggaaacgaaccgaacgaccgtacgttaacgttaacttacgttaggttagggttaacggtttaacggtttaagttttagg

SEQ ID NO: 353361 - DNA, 588 bp, Homo sapiens
  misc_feature: GZ8MTXP02J0EF9.4.33.C11.1.454.CMB.2.raw
  modified_base (255)..(255): a, c, t, g, unknown or other
  misc_feature (255)..(255): n is a, c, g, or t
  modified_base (330)..(330): a, c, t, g, unknown or other
  misc_feature (330)..(330): n is a, c, g, or t
tcagagcactgtagcacgaccggtgctcgatttagagtgagctcgttgggtttggggagtgtgaggggacatgagtggtagaaacagtggatatgtgtggcagtgtctgaccttggttgtttttttgttgtaggtgtccaatgtgaggtgcagctggtggagtctggggagcttggtccagccagggcgtccctgagactctcctgtacagcgtctggattcaacttttcgtgattatgccatgaactgggtccncaggctccgagggagggctggagtgggtagttcattagagccagtggcttagtgcgtggacaacagaatcgccgngtctgtagaaagcagtattcatcatcacgaaagagatgacttaccgaaacggcatccgactatctgcgtagatacgaacacgctagaacgaccgagacacgacggtccgtactagtttacgtggttagggtttaagggttagtttaacgtagtttttaggagttaggtattaactttaccgtaaccccctatttacgaaccgttaacgtacggggtacccgtaacggggtaacccgttccgggtaccgtccggttccc

SEQ ID NO: 353362 - DNA, 495 bp, Homo sapiens
  misc_feature: GZ8MTXP02GSVJF.4.33.C11.1.454.CMB.2.raw
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactactagcttggtatcagcagaaaccaggacagcctctaagctgctcatttaccgggcagctaccccgggaatccggggtcctgagcgattcagtggcagcggtctgggacagatttcactctcacatcagcagcctgcaggctgaagatgtggctagtttattactgtcagcaatacttctactactcctacgtactttcggcggtaggaaccgaaggtcggagatcaaacgactagg

SEQ ID NO: 353363 - DNA, 601 bp, Homo sapiens
  misc_feature: GZ8MTXP02GY5PL.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctaccaaacaatgaagaaactaattagcttaggtatcagcaagaaaccaggacacgcctactaagctgctactacgtttaccgggcacggccgtaacccccggggaacgtccccggggtaccctggacgtcgtacttcgagtcgggcgacgggtccggggtcgtaggggactagtactttccgacctccctacacctactacgacgacgaccgtccgtacgacggacgtacgtaagagtagtgggtacgtacgtttaagtttactacgtcgtacagtaactattacttactacttaccgtcgtacgtacgtacggacggaacggtaacgtaggtacgacgacgtaacgaacgagtacgg

SEQ ID NO: 353364 - DNA, 635 bp, Homo sapiens
  misc_feature: GZ8MTXP02G284Z.4.33.C11.1.454.CMB.2.raw
  modified_base (303)..(303): a, c, t, g, unknown or other
  misc_feature (303)..(303): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagcttgggttttccttgttgctattttaaaaggtgtccaatgtgaggtgcagctggtggagtcgtgggggagcttggtccagccagggcgtccctgagactctcctgtacagcgtctggattcaactttcgtgattatgccatgaacgtggggtcccncgaggctccgaggggagggctgggagtgggtaggtttcagttagagccagtggctttagcgcgtaggggaacaaacgagaaactaccggcccggtcgttcgtaggtaggaaaagggcaaggtaacttccatcatctacaaagagtatagtaacttaccgaacggtcaactccgaccttatcgtcgacaagatacggaaacacgaccgtaggaaacgaccggaacggaacaccgacgtacccgttcttaaacgttacgtaggtttaggtttaagggttaagttttaacggttagtttttagggagtttaggtaactttaacgtttaaaccccg

SEQ ID NO: 353365 - DNA, 564 bp, Homo sapiens
  misc_feature: GZ8MTXP02HDPT4.4.33.C11.1.454.CMB.2.raw
  modified_base (185)..(185): a, c, t, g, unknown or other
  misc_feature (185)..(185): n is a, c, g, or t
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (363)..(363): a, c, t, g, unknown or other
  misc_feature (363)..(363): n is a, c, g, or t
  modified_base (393)..(393): a, c, t, g, unknown or other
  misc_feature (393)..(393): n is a, c, g, or t
  modified_base (523)..(523): a, c, t, g, unknown or other
  misc_feature (523)..(523): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtntccaatgtgaggtgcagctggtggagtcgtgggggagcttggtccagccaggggccgtccctgagactctcctgtacngcgtctggattcaactttcgngatttatgccatgaacgtgggtcccncgaggctccgaggggaggctggagtgggtagttcagttgagcagtggcttagngctgggacacgagaactaccgccgcgtcgnggtagaagcagtattcatcattcacaaagagtagtagtacttaccgtaacggtactcgtaccctagttcctgacgagtatacgaacacgacgtagaaacgacgaaggacacgacgtcctactacttacgngtttttaggaggtttacgtttagtagttttaggagtttaag

SEQ ID NO: 353366 - DNA, 672 bp, Homo sapiens
  misc_feature: GZ8MTXP02JOOPF.4.33.C11.1.454.CMB.2.raw
  modified_base (281)..(281): a, c, t, g, unknown or other
  misc_feature (281)..(281): n is a, c, g, or t
  modified_base (304)..(304): a, c, t, g, unknown or other
  misc_feature (304)..(304): n is a, c, g, or t
tcagagcactgtagcacgaccggtgctcgatttagagtgagctcgttggggtttgggggggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggagcttggtccagccagggccggtccctgagactctcctgtacagcgtctggattcaactttcgngattatgccatgaactgggtccncaggctccgaggggagggctgggagtgggtagttcagttagagccagtggcttatcggctaggggaacaaacgagaaactaccgccgtcgtctaggtagaaaggcaagtattcatcatctacaaagagatagtaacttaccgaacggactaacgtcccgtaccttacgtctacggaccaaagtaacgtacgaaaccgacggacccgtaaggaaaccggaacccggaaacgggaacctaaccgacggtaccccggttacttaaacgtttaccggttacggtttaagggtttaaggggtttaacgtttttaacggttaaggttttttacggggaaggtttacgggtaaactttaacttttaaaacccccg

SEQ ID NO: 353367 - DNA, 557 bp, Homo sapiens
  misc_feature: GZ8MTXP02FWQ5Z.4.33.C11.1.454.CMB.2.raw
  modified_base (250)..(250): a, c, t, g, unknown or other
  misc_feature (250)..(250): n is a, c, g, or t
  modified_base (422)..(422): a, c, t, g, unknown or other
  misc_feature (422)..(422): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttatatacagctcaaanaatgaagaactactagcttggtatcagcaagaaaccaggacagcctactaagctgctactacgttaccggcacggccgtaacccccggggaagtccccggggtcctggacgcgtaattcgagtggcgaggtcggggtctgggactagtattcactctacacatcagcagccngacaggctagagtgtaggtgtactagtttacttacgtgtacagtactaaattacttactactacgttaccgtcggtacgttcgggacggtaacggaaccgtaagggtaggacgtacgtaacgaaacgtacgtagg

SEQ ID NO: 353368 - DNA, 519 bp, Homo sapiens
  misc_feature: GZ8MTXP02F6COX.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgaagaactactagcttggtatcagcaagaaaccaggacagccctactaagctgctcatttaccggcagcctacccccgggaatcccggggtcctgagcgattcgagtggcagcggtctgggacagatttcactctcaccatcagcagcctgcaggctgaagatggtgactagtttattacgtgtcagtactaattacttctacttactcctcggtactttcggcggtaacggaaccgaaggtacggagagtacgaaaacgaacttgg

SEQ ID NO: 353369 - DNA, 605 bp, Homo sapiens
  misc_feature: GZ8MTXP02I369R.4.33.C11.1.454.CMB.2.raw
  modified_base (299)..(299): a, c, t, g, unknown or other
  misc_feature (299)..(299): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagctgggttttccttgttgctatttaaaaggtgtccaatgtgaggtgcagctggtggagtcgtgggggagcttggtccagccagggcggtccctgagactctcctgtacagcgtctggattcaactttcgtgattatgccatgaactgggtccnccaggctccgaggggaagggctggaggtgggtaggtttcagttagagccagtggacttagcgctaggggacaaacgagaactaccgccgcgtctggtagaaaggcagtattcatcatctacaaagagatagaacttacccgaaacggctaactaccgtacccttaattcctggaccaagtaactacgaaacacgacctagaaacgaccgaaggacacgacgcccgtacttaacttacgtgttaggttaaggggttaagttttaacgttagtttttagggagttaggtaactttaactttaaacccg

SEQ ID NO: 353370 - DNA, 592 bp, Homo sapiens
  misc_feature: GZ8MTXP02I943J.4.33.C11.1.454.CMB.2.raw
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (444)..(444): a, c, t, g, unknown or other
  misc_feature (444)..(444): n is a, c, g, or t
  modified_base (503)..(503): a, c, t, g, unknown or other
  misc_feature (503)..(503): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttaattttaaaaggtgtccaatgtgaggtgcagctggtggagtcgtgggggagcttggtccagccaggggcgtccctgagactctcctgtacagcgtctggattcaactttcgngatttangccatgaactgggtccncgaggctccgagggagggctggaggtgggtagttcagttagcgccagtggtcttagtggctggggaacaacgagaaactaccggccgtagttcgtggtaggaaaacggctaaggtatttacattaccattccanaaagagatgaaacttcccgaaacggcaagttccgccctaatccgagcaagataggaacngcctaggaaacgaccgaggacacgacgtccgttactagttcgtagttacgggttaagggtacgtttttacggttagttttggggtaacg

SEQ ID NO: 353371 - DNA, 649 bp, Homo sapiens
  misc_feature: GZ8MTXP02HQYJP.4.33.C11.1.454.CMB.2.raw
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttanatacagctaccaaanatagaanaactatagntaganacagacaagaaacagacacgacctacaagctacgactacgtacgttaccggacacgtaccggtaacccccgggtaacgtccccggggtcctaggacgtacgtagttcgaggtcggacgacgggtccggggtacgtagggaactagttacttccactcctaccaacctatacgacgacgacgccgtagacgtacggtactaaggaagtagtggtacgttacgttaagtttacttacgtacgtacaacgtaactaaacttaacttacttaccttaccgttaccgttaccggttaccggttaccgggtaaccgggtaacgggtaaacggtaacgggtaacgggtaacgtaaacgtaaaccgtaaaacgtaacggtacgg

SEQ ID NO: 353372 - DNA, 569 bp, Homo sapiens
  misc_feature: GZ8MTXP02HXWAG.4.33.C11.1.454.CMB.2.raw
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
  modified_base (414)..(414): a, c, t, g, unknown or other
  misc_feature (414)..(414): n is a, c, g, or t
  modified_base (460)..(460): a, c, t, g, unknown or other
  misc_feature (460)..(460): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttggcttagctgggttttcctgttgctattttaaaggtgtccaatgtgaggtgcagctggtggagtcgtgggggagcttggtccagccagggcggtccctgagactctcctgtacagcgtctggattcaacttttcgngattatgccatgaactgggtccnccaggctccgaggggagggctgggagtggggttagtttcagttagagccatggctttagngctggggacacagaatacgccgcgtcagtagaagcagatcatcatctanaagagatagtataccgaacgactactccgtactactctgacgaganagaacgacgtacgtaacgaacggaaccgaacggaaccgacgacgtaccgttactacgttaacgttaggttacggtttacggttagttttacggtttagtttttaggtag

SEQ ID NO: 353373 - DNA, 521 bp, Homo sapiens
  misc_feature: GZ8MTXP02FJ5J0.4.33.C11.1.454.CMB.2.raw
  modified_base (236)..(236): a, c, t, g, unknown or other
  misc_feature (236)..(236): n is a, c, g, or t
  modified_base (318)..(318): a, c, t, g, unknown or other
  misc_feature (318)..(318): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttanatacagctcaacaatgagactacttagcttggatcagcaagaaaccaggacagccctactaagctagctcagtttaccgggnacgcgtacccccgggatcccggggtcctgagcgattcaggtggcagcgggtctgggacagatttcgactctcaccatcagcagcctgacaggctagagatgtgactagtttattactgtcagtctaaattacttactactacctccgtcggtactttcggcggaggtaaccgaagggtcggaagtacgtacgaaacgactagg

SEQ ID NO: 353374 - DNA, 521 bp, Homo sapiens
  misc_feature: GZ8MTXP02IMB39.4.33.C11.1.454.CMB.2.raw
  modified_base (309)..(309): a, c, t, g, unknown or other
  misc_feature (309)..(309): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaaggtgtccaatgtgaggtgcagctgggtggagtcgtgggggaggcttggtccagcccagggcggtccctgagactctcctgtacagcgtctggattcaactttcgtgattatgccatgaactgggtccncaggctccgagggagggctggagtgggtagttcattagagcatgcttatgctggacagagaatacgccncgtntgtagaaaggcagatcatcatctacaaagagatgattaccaaacggcactcgcctatcctgcagatagaacagcctagaacgacgacggacacacgccgtctattaagtgtaggttaggtagtttacgtagttttggag

SEQ ID NO: 353375 - DNA, 553 bp, Homo sapiens
  misc_feature: GZ8MTXP02HJR2Q.4.33.C11.1.454.CMB.2.raw
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
  modified_base (452)..(452): a, c, t, g, unknown or other
  misc_feature (452)..(452): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggagcttggtccagccagggcgtccctgagactctcctgtacagcgtctggattcaactttcgngattatgccatgaactgggtccncaggctccgaggggagggctggagtgggtagtttcagttagagcatcggcttagtgcgtagggaacacgagaaataccgccgcgtctgtagaaagcagtatcatcatctacaagagatgattaccgaacggctaactccgactatcngtcagatagaacacgaccgtacgaaacgaccgacggaacacgacgccgtactaacttaacgtgttaggttacgggtagttttacggtagtttttagggtag

SEQ ID NO: 353376 - DNA, 583 bp, Homo sapiens
  misc_feature: GZ8MTXP02JNF7K.4.33.C11.1.454.CMB.2.raw
  modified_base (288)..(288): a, c, t, g, unknown or other
  misc_feature (288)..(288): n is a, c, g, or t
  modified_base (311)..(311): a, c, t, g, unknown or other
  misc_feature (311)..(311): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttgggtccagccgaggggcggtccctgagactctcctgtacagcgtctggattcaactttcgngattatgccatgaactgggtccncaggctccgaggggagggctgggagtgggtagtttcattagagccagtggcttangctgggacacgngaatacgccgngtcngtagaaagcagatcatcatctacaagagtatagtacttcccgaaacggtctaagtcccgtacttaactctagacctaggactacgaactacgccgtaacggaaacggaccgacgggaaccacgacggaccttactaaacgttcgtggttaacggttaggggttaacgttttacggtagttttaggtaagg

SEQ ID NO: 353377 - DNA, 554 bp, Homo sapiens
  misc_feature: GZ8MTXP02G2H9Y.4.33.C11.1.454.CMB.2.raw
tcagagcactgtagcacgaccggtgctcgatttagagtgagctcggttgggttggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttaatatacagctcaaacaatgagaactactagcttggtatcagcaagaaaccaggacagcctactaagctgctcacgtttaccggcagctaaccccgggatccggggtcctggagcgattcgagtggcaggcggtctgggacagtatttcactctcaccatcagcagcctgacaggtctaggaagagttggtaggtactaagtttaattacgttgtacaagtactaaattacttactaacttaactccgtacggtaccgtttacgggacggaacggaaccgtaagggtacggtaagtacgtaacgaaaacgtaacgtcgg

SEQ ID NO: 353378 - DNA, 569 bp, Homo sapiens
  misc_feature: GZ8MTXP02HF6JD.4.33.C11.1.454.CMB.2.raw
  modified_base (386)..(386): a, c, t, g, unknown or other
  misc_feature (386)..(386): n is a, c, g, or t
  modified_base (418)..(418): a, c, t, g, unknown or other
  misc_feature (418)..(418): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttatatacagctccaacaatgaagaactacttagcttggtatcagacaagaaaccaggacacgcctacctaagctgctcacgtttaccgggcaggccgtaacccccggggactcccggggtccctggacgcgattcgagtggcaggcgggtcngggacagtattcactctacacatcagcagccngacgaggcagaagtagtggtagtacgtagtttactcgtgtacacgtactaattacttactacttaccgtccgttacggttaccgttaccgggacggtaacgggaaccgtaaagggtacggtaacgtaacgtaaccgtaaacggtacgtcgg

SEQ ID NO: 353379 - DNA, 583 bp, Homo sapiens
  misc_feature: GZ8MTXP02H4CID.4.33.C11.1.454.CMB.2.raw
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttatatacagctaccaacaatgaagaactacttagcttggtatcagcaagaaaccaggacacgcctactaagctgctctacgtttaccggcagaccgtacccccggggaatcccggggtccctggagcgattcgaggcggcaggcgggtcgtgggacagtattcacctctacacccagtcagcacgcctgcgacggctaggaagagtggtacgcgttaaggtttactttacgtcgttacaagtactaaaattactttaccttaaacttaccttcccgttacggttaccgtttaccgggacgggtaacgggaaccgtaaaggtacggaaggtactaaacgaaacgtaaactcgg

SEQ ID NO: 353380 - DNA, 667 bp, Homo sapiens
  misc_feature: GZ8MTXP02JB0GC.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccacatcaactgacaagtccagccagagtgttatatacagctaccaaacaatgaagaactacttagcttggtatcagcaagaaaccaggacacgcctactaagctgctctacgtttaccgggctacggccgtaaccccccggggaacgtcccggggtaccctaggacgacgtattccgaggtcggacgacggggtccggggtacgtacggggaacctaaggtactttaccgaaccttctaccaaccctataccgaacggcctaacgcccgtaggaccgacgggtacgtaagggaagtagttgggtacggtacgttaaggttttacttaaccgtggtacctaagtactaaattacttaccttaaccttaaccgttccgttacgggttaccgttaccggggacgggaacgggtaaccggtaaggggttacggaacgtaacgtaaccggtaaaacgtacgttacggg

SEQ ID NO: 353381 - DNA, 618 bp, Homo sapiens
  misc_feature: GZ8MTXP02JYN6A.4.33.C11.1.454.CMB.2.raw
  modified_base (502)..(502): a, c, t, g, unknown or other
  misc_feature (502)..(502): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagtgttatatacagcctaccaacaatgaagaactacttagcttaggtactacagacaagaaaccaggacagcctacaagctgctctacgttaccggggcacggaccgtaaccccggggactcccggggtccctaggacgccgattcgaggtcggaccgaggccgggtcgtagggactagtactttcacttctccaccgtataccgacgtaccgacgccctaggaccgagggtccgttaaggaagtagtgggtaggacttaagtttattacgtntacgagtactaaattcttaccttactaccgttaccgttacgggttaccgttccggggacggtaacgggtaaccgtaagggttacggacgtaacgtaacgaaaaccggtaagtcggg

SEQ ID NO: 353382 - DNA, 539 bp, Homo sapiens
  misc_feature: GZ8MTXP02GS04N.4.33.C11.1.454.CMB.2.raw
  modified_base (292)..(292): a, c, t, g, unknown or other
  misc_feature (292)..(292): n is a, c, g, or t
  modified_base (371)..(371): a, c, t, g, unknown or other
  misc_feature (371)..(371): n is a, c, g, or t
tcagagcactgtagcacgaccggtgctcgatttagagtgagctcgttgggtttgggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtggggggaggcttggtccagccagggcggtccctgagactctcctgtacagcgtctggattcaactttcgtgattatgccatgaactgggccnccaggctccgagggagggctggagtgggtagttcagttagagccagtggcttagtgctgggacaacgagaatacgccgngtctgtgaaagcagattcatcatctcaagagatagacttaccaacggcactcgccctatctgctagatgaacagcctagaacgacgacgacacacgccgtctacttacgtagtagttaggtagtttacgtaagttttggagttggtatacttaacgtaaccccttacg

SEQ ID NO: 353383 - DNA, 601 bp, Homo sapiens
  misc_feature: GZ8MTXP02J3N3J.4.33.C11.1.454.CMB.2.raw
  modified_base (186)..(186): a, c, t, g, unknown or other
  misc_feature (186)..(186): n is a, c, g, or t
  modified_base (291)..(291): a, c, t, g, unknown or other
  misc_feature (291)..(291): n is a, c, g, or t
  modified_base (367)..(367): a, c, t, g, unknown or other
  misc_feature (367)..(367): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttggcttagcttgggttttcctgttgctaattttaaaaggtntccaatgtgaggtgcagctggtggagtcgtgggggagcttggccagccagggccgtccctgagactctcctgtacagcgtctggattcaaactttcgagatttangaccatgaacgtgggtccccgccgaggcctaccggaggggaacggggtctgggagttggggtaggtttcagttagngccagtggcttagtgcgtaggggaacacgagaactaccgccgtcgtctggtagaaacgcagacttacactcatacctagaagaagtatacgtacttaccaacggactacgtaccgtacctatccgtagaccaagaacgtagaacacggactacgaacgaccgaacgacacgacgaccgttactacttaacgtagttacggttacgggtttagtttacgttagttttaggtaagg

SEQ ID NO: 353384 - DNA, 559 bp, Homo sapiens
  misc_feature: GZ8MTXP02HCU9J.4.33.C11.1.454.CMB.2.raw
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (451)..(451): a, c, t, g, unknown or other
  misc_feature (451)..(451): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccaggggcggtccctgagactctcctgtacngcgtctggattcaactttcgngattatgccatgaactgggtccnccaggctccgaggggagggctggagtggtagttcattagngcatggcttangctgggacacngaatacgccgngtcngtgaaagcagattcatccatctacaaagagatgacttaccgaaacgggctatccgcctaattccngcaagatacgaacagccctaaggaacggacccggaggaacaccgacgtccccgttataagttcgtggttacggtttaaggggtagtttttacgtagtttttcgggaag

SEQ ID NO: 353385 - DNA, 654 bp, Homo sapiens
  misc_feature: GZ8MTXP02F1W5D.4.33.C11.1.454.CMB.2.raw
  modified_base (304)..(304): a, c, t, g, unknown or other
  misc_feature (304)..(304): n is a, c, g, or t
  modified_base (423)..(423): a, c, t, g, unknown or other
  misc_feature (423)..(423): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggtttccttgttgctatttaaaggtgtccaatgtgaggtgcagctggtggagtcgtgggggagcttggtccagccgagggcgtccctgagactctcctgtacagcgtctggattcaactttcgtgattatgccatgaactgggtcccncaggcctcgaggggagggctggagtgggtagtttcattagagcatggcttatgcgtagggaacacgagtaaactaccggcccgcgttactggtaggaaaggcaagattcatcatcctanaaagagaatgtaacttaccgaaacggctacgtccgtacccttaatcccgttaggaccaaggtaaacgtacgaaaaccgtacgaccgtaaacggaaaccggaaaccggaaacggtaaacccgaaaccgaccgtacccgttaacgtttaaaccgtttaacggtttagggtttaacggggttttaaacggggtttaacggtttttaacggtttaacggtttttaggggtaacgg

SEQ ID NO: 353386 - DNA, 610 bp, Homo sapiens
  misc_feature: GZ8MTXP02JEOEM.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagagtgttatatacagcctaccaaacaatgaagtaaactacttagcttaggtatcagacaagaaaccaggacagccctactaagctgctacgtacgttacccgggctaacggccgtaaccccccggggaacgtcccccgggggtaccctgggacgtccgtattccggagtcgggcgagggcggggtctaggggactagtatttcactctacaccctatcagcagcctgcgaggctaggaagagtgggtagacttaagtttatacgtgtacagtactaaattacttacctactaccgtccgttacggtacgtttaccggggacgggaacggtaacccggtaaagggtaggaacgtacgtaaacgaaaccggtaacgttcggg

SEQ ID NO: 353387 - DNA, 534 bp, Homo sapiens
  misc_feature: GZ8MTXP02IQWUT.4.33.C11.1.454.CMB.2.raw
  modified_base (418)..(418): a, c, t, g, unknown or other
  misc_feature (418)..(418): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgttatgacccagtctccagactccctggctgtgtctctgggcgagagggccaccatcaactgcaagtccagccagagtgttatatacagctaccaacaatgagaactacttagcttggtatcagcagaaaccaggacagcctcctaagctgctcatttaccgggcagcctaccgggaactcccggggtccctgagagattcaggtggcaggcgggtctggggacagtatttcactctcaccatcagcagcctgcaggctagaagntgtggactagtttatactgtcagactaaatacttactacttacctccgttacggtactttccgggacggtacggaaccgtaagggtcggaagtactacgaaaacgtactaggtcgg

SEQ ID NO: 353388 - DNA, 501 bp, Homo sapiens
  misc_feature: GZ8MTXP02FQN3Y.4.33.C11.1.454.CMB.2.raw
  modified_base (487)..(487): a, c, t, g, unknown or other
  misc_feature (487)..(487): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactactagcttggtatcagcagaaaccaggacagcctcctaagctgctcatttaccggggcagctacccccgggaatccggggtccctgagcgattcagtggcagcgggtctgggacagatttcactctcaccatcagcagcctgcaggctgagatgtggcagtttattactgtcagcaatattctactactcctcggtacttcggcggacgggaaccgaaggtaggacganacaaaacgactagg

SEQ ID NO: 353389 - DNA, 642 bp, Homo sapiens
  misc_feature: GZ8MTXP02F5FAO.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccatcaactgacaagtccagccagagtgttatatacagctaccaacaatgaagaaactacttagcttaggtatcaagcaaagaaaccaggaacacgtccctaccgtaagctgcctactaacgtttacccgggactaacggtaccgtaacccccccggggaacgtcccccgggggtaccctaggaacggtccgtatttccggaaggttcgggacgtacggggcggggttacgtaggggaacagttactttccgactctaccaacctacacagcgacgaccgtgaccgaggacgtaggaagtagtcggtagtaccgttaagtttacttacgtgtacgagtactaattacttacttactaccgtccgttacggtacgtttccgggacggaacgggtaaccgaagggtacggaacgtacgtaaacgaaacgacgttacgg

SEQ ID NO: 353390 - DNA, 556 bp, Homo sapiens
  misc_feature: GZ8MTXP02JU3SS.4.33.C11.1.454.CMB.2.raw
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccagggcgtccctgagactctcctgtacagcgtctggattcaactttcgngtattangccatgaactgggtccnccaggctcgaggggagggctggagtgggtagttcattagngcagtggcttagngcgtgggacacgagaaactaccgccgcgtctggtacgaaagcagacttcatcatctacaaagagatagattacccgaaacggctacgtccgaccttaatccgtagacaagatagaacacgccgtagaaacgaccggagacaacgacgcctactattaacgtgttaggtacggttagtttacgtagttttaggagg

SEQ ID NO: 353391 - DNA, 603 bp, Homo sapiens
  misc_feature: GZ8MTXP02IATVQ.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggggcgagagggccaccatcaactgcaagtccagccagagtgttatatacagctaccaacatgaagaactactagcttggtatcagcaagaaaccaggacagcctacctaagctgctacacgtttaccgggcacgccgtacccccgggaacgtccccggggtccctggacgcgtattccgaggtcggcgacggtccggggtcgaggggacagtacttccactctaccacctatcagcacgcctgcgagggctaggaagtagtggtacgggtacttaggtttattacgtggtacctagtactaaattacttaccttaaccttaccgttacccgttacgggttaccgtttccggggacggtaacggggtaaccgaagggttacggacggtaacgtaccgaaaacgtaacgtggg

SEQ ID NO: 353392 - DNA, 660 bp, Homo sapiens
  misc_feature: GZ8MTXP02JWN8P.4.33.C11.1.454.CMB.2.raw
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctatttaaagtgtccaatgtgaggtgcagctggtggagtcgtgggggaggcttggtccagccgagggcggtccctgagactctcctgtacagcgtctggattcaactttcgtgtatttatgcctatcggaacgtcggggtcccgccgacgggcctaccggaagggggacggggcgttaggggagggtttggggttaggtttcaagttaggacgcctagtggtctttagngtcgtaggggaactanaggaaacttaccggccgtcgttcgtaggtaggaaacggcaaggtacttacatctactctacgaaagagtactgaaccttaccgaaacggctacgtaccgtcccttatcctggacaggtatacgaaacgacgaccgtaggaaaaccggaccggaaacggaccacgtacggtcccgttacttaacgttaacgttggtttacgggttacggggtttacgttttacggtttacggttttagggtaagg

SEQ ID NO: 353393 - DNA, 623 bp, Homo sapiens
  misc_feature: GZ8MTXP02HOAPD.4.33.C11.1.454.CMB.2.raw
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (425)..(425): a, c, t, g, unknown or other
  misc_feature (425)..(425): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgttatgaccagtctccagactcctggctgtgtctctgggcgagagggccaccatcaactgacaagtccagccagagtgttatatacagctcccaaaananagaanaactatagctaganacagacaagaaacagacacgcctacaagctagactacgtacgttaccggacacggaccgtaaccgggaaccgtccccggggtacctaggacgtcgtaacttcgaggtcggacgagggtcgggtacgtagggactagtacttacactcacacanacacgacgacgacgacgacgacgacgtagaagtagtagtacggtacgttacgtttaacgttacgtacgtacgtacgtaactaaacttaacttacttaccttacctaccgtaccggttaccggttaccgggtacgggaacgggtaacggtaacggtaacggtaacgtaacgtaaacgtaaaacgtaaacgtacgtacgg

SEQ ID NO: 353394 - DNA, 578 bp, Homo sapiens
  misc_feature: GZ8MTXP02I0J45.4.33.C11.1.454.CMB.2.raw
  modified_base (262)..(262): a, c, t, g, unknown or other
  misc_feature (262)..(262): n is a, c, g, or t
  modified_base (359)..(359): a, c, t, g, unknown or other
  misc_feature (359)..(359): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (475)..(475): a, c, t, g, unknown or other
  misc_feature (475)..(475): n is a, c, g, or t
  modified_base (517)..(517): a, c, t, g, unknown or other
  misc_feature (517)..(517): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgtgctattttaaaaggtgtccaatgtgaggtgcagctgggtggagtcgtgggggaggcttggtccagccagggcgtccctgagactctcctgtacngcgtctggattcaactttcgtgattatgccatgaactgggtccgcaggctccgagggagggctggagtgggtagttcattagagccagtggcttagngctaggggaacacgagaaactaccgccgtcgtctagggtagaaaaggcagtatcatcatcctanaaganatgaacttccgaaaggctatccgcttaatctacgcagatacgaaacngacctaggaaacgaacggacggaacctaacgcgtacccgttnttaacgttaacgtggtttacggtttaaggggttagtttttacggttagtttttagggtagg

SEQ ID NO: 353395 - DNA, 644 bp, Homo sapiens
  misc_feature: GZ8MTXP02F9LFG.4.33.C11.1.454.CMB.2.raw
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccagggccggtccctgagactctcctgtacagcgtctggattcaactttcgtgatttatgcctatcgaacgttcggggtcccgcccgaggcctaccgagggggaacggggcgtggggaggttggggttaggttttcaagtttaggaggccctaagtcggtactttagtcggcgtaggggaacaaacgtaggaaacttaccggcccggtcgttctggtagaaagggcagtattcatcatctacgaagagattagtaacttacccgaaacggctaacgtccgacccttaatcctagaccgtaagactacgaaacgcgtaccctaggaaacgaccgaaggaaccacgacgccgtactacttacgtagtggttaagggttaagtttacgtagttttaggagtaggtattaactttaaccc

SEQ ID NO: 353396 - DNA, 602 bp, Homo sapiens
  misc_feature: GZ8MTXP02JNORL.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacgggccaccatcaactgacaagtccagccagagttgttatatacagctccaaacaatgaagaactacttagcttggtatcagcaagaaaccaggacagcctcaagctgctcatttaccgggcagcctaccccggggacgtccggggtccctgagcgattcgaggtcggcgacggcggggtcgtagggacagtatttcgactctcaccgatccagcagccgtgcgaggctagaacgtagtgtaggcttagtttacttacgtgtaccgaagtactaaaacttactttacctaaccgttaccctccgttacgggttaacccgtttccgggggacgggtaaacggggaacccgtaaaggggtaggtaacggtaacgtaaccgaaaaccggtaacgtttacgggg

SEQ ID NO: 353397 - DNA, 585 bp, Homo sapiens
  misc_feature: GZ8MTXP02I81IZ.4.33.C11.1.454.CMB.2.raw
  modified_base (467)..(467): a, c, t, g, unknown or other
  misc_feature (467)..(467): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctgaatctctggtgcctacggggacatcgtgatgacccagtctccagactccctggctgtgtctcgtgggcgagacgggccaccatcaactgacaagtccagccagagtgttatatacagctacaaacaatgaagaactacttagcttggtatcagacaagaaaccaggacagtaccctactaaggctacgacttacgtaacgtttaccggggacaacggtccgtaaccccccggggaacgttccccggggtacctaggacgacgtattcggagtcggcgaggcgggtacgcgggacagtatttcactctacacatcgagcacgctcgcgagctaagaagtntgggacgtgttaagtttatacgtacgtctagactaatacttactactaccgtctacggtaacgttcggacggaacgggaaccgtaaagggtcggaagacgtaacgaaaacgtacgtgg

SEQ ID NO: 353398 - DNA, 569 bp, Homo sapiens
  misc_feature: GZ8MTXP02GR277.4.33.C11.1.454.CMB.2.raw
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgcttattttaaaaggtgtccaatgtgaggtgcagctggtggagtctgggggagcttggtccagccagggcggtccctgagactctcctgtacagcgtctggattcaactttcgtgatttatgccatgaactgggtccgccaggctccgaggggaaggggctggagtgggtaggttcattagagccatgcttangctgggacacagaaatacgccgcgtcngtagaaagcagatcatcanctacaaagtagatgaattaccgaaacggcatccgaccttatacctgacagaatacgaaacagccctagaaaacggaacccggaggaaaccaacacgacccgtacttaagttaaccgtggttagtttaacggggtatttttaacggtagtttttgggaaagg

SEQ ID NO: 353399 - DNA, 568 bp, Homo sapiens
  misc_feature: GZ8MTXP02GXVLK.4.33.C11.1.454.CMB.2.raw
  modified_base (369)..(369): a, c, t, g, unknown or other
  misc_feature (369)..(369): n is a, c, g, or t
  modified_base (412)..(412): a, c, t, g, unknown or other
  misc_feature (412)..(412): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtacctacggggacatcgtgatgacccagtctccagactccctggctgtgtctcgtgggcgagacgggccaccatcaactgcaagtccagccagagtgttatatacagctaccaacaatgagaactacttagcttaggatcagacaagaaaccaggtacagcctactaagctgctcacgtttaccgggcacgaccgtaacccgggacgtcccggggtcctggacgcgtattcgnggtcgcgaggcggtcgtagggactagtattcactctacaaccntacacgacgacgccgtgacgaagggcttaaggaaggtagtggtagggactaagtttactacgttgtacagtactaattacttacttactactccgtacgtacgttcggacggtacggtaacgaaggtaggacgaacgacgtaaacgaacgttgacg

SEQ ID NO: 353400 - DNA, 615 bp, Homo sapiens
  misc_feature: GZ8MTXP02HTV6K.4.33.C11.1.454.CMB.2.raw
  modified_base (403)..(403): a, c, t, g, unknown or other
  misc_feature (403)..(403): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtggggcgaggacgggccacatcaactgacaagtccagccagtagtgttatatacagcctaccaaacaatgaagaaactacttagcttaggtatcaagacaagaaaccgaggaccacgccctactaagctgctactacgttaccgggacacggacccgtaaccccccggggagtccccggggtcctggacgcgtattccgaggtcggacgngggtcgggtcgtagggacagtacgttccactcctacactactcacgcgacgccgtacgcgaggctaggaagtatgggtagtacgttaagtttactacgtgtacaagtactaattacttacttaccctacgtccgttacgggttaccgttcggggaaccgggtaacggtaaccggtaaggtacggaagtaacgtaaacgtaaacggtagtcgg

SEQ ID NO: 353401 - DNA, 609 bp, Homo sapiens
  misc_feature: GZ8MTXP02F11CM.4.33.C11.1.454.CMB.2.raw
  modified_base (371)..(371): a, c, t, g, unknown or other
  misc_feature (371)..(371): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaaggtgtccaatgtgaggtgcagctggtggagtcgtgggggagcttggtccagccgagggcggtccctgagactctcctgtacagcgtctggattcaactttcgtgtattatgccatgaacgtgggtcccgcgaggctccgaggggaagggctgggagtggggtaggtttcagttagagccagtggtcttanggctaggggaacacgagaaactaccggcccgacgtctaggtagaaaggcaagtattacattcattcctacaaagagatgtaacttacccgaaacggctaacgtccgtaccttatcctgacagtactaggaacagcccgtaaggaacggaaccggacggaccacgacgtaccgtcttaacgttaacgttggttacgggtttaaggggttacgtttttacggttagtttttagggtaagg

SEQ ID NO: 353402 - DNA, 518 bp, Homo sapiens
  misc_feature: GZ8MTXP02FVQ4Y.4.33.C11.1.454.CMB.2.raw
  modified_base (317)..(317): a, c, t, g, unknown or other
  misc_feature (317)..(317): n is a, c, g, or t
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
  modified_base (481)..(481): a, c, t, g, unknown or other
  misc_feature (481)..(481): n is a, c, g, or t
  modified_base (503)..(503): a, c, t, g, unknown or other
  misc_feature (503)..(503): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaaacaatgagaactacttagcttggtatcagcaagaaaccaggacagcctctaagctgctcatttaccggnagcctacccccgggaatccggggtccctgacgccgattcagtcggcagcgggtctggggacagtntttcactctcaccatcagcagcctgccaggctagaaagntggtggctagtttatactgtacagctaaatacttactactactcctacggtacgttcggnggtacggaaccgaaggtcgganagtacaaacgactgg

SEQ ID NO: 353403 - DNA, 555 bp, Homo sapiens
  misc_feature: GZ8MTXP02FKUXE.4.33.C11.1.454.CMB.2.raw
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (444)..(444): a, c, t, g, unknown or other
  misc_feature (444)..(444): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccagggcgtccctgagactctcctgtacagcgtctggattcaacttttcgngattangccatgaactgggtccnccaggctccgaggggagggctgggagtgggtagtttcagttagagccatggcttagcgcgtgggaacaacagaactaccgccgcgtctggtagaaaggcagattcatcatctanaaganatgattaccgaacgcatccgctanctgacagatagaacagcctagaacgaccgaggacacgacgcgtactacttacgtagtcgttaagggtaagttttacgtagttttaggagttggtaacttacgtttaaaccc

SEQ ID NO: 353404 - DNA, 548 bp, Homo sapiens
  misc_feature: GZ8MTXP02GMH04.4.33.C11.1.454.CMB.2.raw
  modified_base (309)..(309): a, c, t, g, unknown or other
  misc_feature (309)..(309): n is a, c, g, or t
  modified_base (364)..(364): a, c, t, g, unknown or other
  misc_feature (364)..(364): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccgagggcggtccctgagactctcctgtacagcgtctggattcaactttcgtgattatgccatgaactgggtccnccaggctccgaggggagggctgggagtgggtagtttcattagagccatggcttangctgggacacagaatacgccgcgtctgtagaaagcagattcatcatctacaagagatgattaccaaacggcatcgacctatctgcagatgaacacgacctaggaaacgaccggaacggacacgacgccgtactattaacgttggttaggtttaggggttagttttacggtagtttttaggtagg

SEQ ID NO: 353405 - DNA, 633 bp, Homo sapiens
  misc_feature: GZ8MTXP02IR3OX.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtatatacagctaccaaacaatgaagaactacttagcttggtatcagcaagaaaccaggacagccctactaagctgcctctacgtttaccgggcacggccgtacccccggggaacgtcccggggtcctagacgtccgtattccgaggtcggcgacgggtcgggtcgtacgggggactagtactttccgacttcctcaacctatccagaccgacgtccctacgaccgagggtacctaggaaagtacgttagggtacggtacttaagtttacttacgtgtacgaagtactaaattacttaccttaaccttacctaccgttacggttaccgtttaccggggacggtaacggggtaaccgaaggggtacggaacgtaacgtaaccgtaaaaccggtaacgttcggg

SEQ ID NO: 353406 - DNA, 538 bp, Homo sapiens
  misc_feature: GZ8MTXP02JM4A0.4.33.C11.1.454.CMB.2.raw
  modified_base (307)..(307): a, c, t, g, unknown or other
  misc_feature (307)..(307): n is a, c, g, or t
  modified_base (384)..(384): a, c, t, g, unknown or other
  misc_feature (384)..(384): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccncaggctccgagggagggctggagtgggtaggtttcagttagagccatggcttagtgctgggacacagaatacgccgngtctgtgaaagcagattcatcatctacaagagatgacttccaaacggcatcgacctagtctgacagatgaacagcctagaaacgaccggaacggacacgacgaccgtactactaacgtgttagttacggggtagttttacgtagttttaggtag

SEQ ID NO: 353407 - DNA, 609 bp, Homo sapiens
  misc_feature: GZ8MTXP02GVAC7.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccagggcgtccctgagactctcctgtacagcgtctggattcaactttcgtgtattatgccatgaacgtgggtcccgccgaggcctccgaggggaaggggctgggaggttgggtaggtttcagttagacgtccagtggcttagtgcgtagggacacgagaactacgccgtcgtctggtagaaagcagtatcatcatctacaagagatagacttccgaacggcatccgacctatcgtcgacagtaatacggaaacacgtacccgtaagaaacggaccggaacggaaccgaacgacggtacccgtacgtttaacgttaacgttggtttaacggggtttaaggggttaacgtttttacggtagttttttagggtaacgg

SEQ ID NO: 353408 - DNA, 553 bp, Homo sapiens
  misc_feature: GZ8MTXP02G1O8I.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctaccaaacaatgaagaactacttagcttggtatcagcaagaaaccaggacagcctactaagctgctcacgtttaccggggcacgccgtacccccggggagtcccggggtccctggacgcgtattcgagtggcgaggcggggtctgggacagtattcactctcaccatccagcacgcctgacgaggctagaagagtggtagacttagtttattacgtgtcagtactaattacttctactacctccgtacggtacgtttacgggacggtacggaaccgtaaggtacggaagtacgtacgaaacggtacgtgg

SEQ ID NO: 353409 - DNA, 612 bp, Homo sapiens
  misc_feature: GZ8MTXP02HN6GF.4.33.C11.1.454.CMB.2.raw
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
  modified_base (311)..(311): a, c, t, g, unknown or other
  misc_feature (311)..(311): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
tcagagcactgtagcacgaccggtgctcgatttagagtgagctcgttgggtttgggggagtgtgaggggacatgagtggtagaaacagtggatatgtgtggcagtgtctgaccttggttgttttttgttgtaggtgtccaatgtgaggtgcagctggtggagtcgtgggggaggcttggtccagccagggcggtccctgagactctcctgtacagcgtctggattcaactttcgngattatgccatgaactgggtccncagctcgagggagggctgggagtgggtagtttcattagagccatggtcttagngcgtagggaacaacgagaaatcgccgcgtctggtagaaaggcagattcatcatctnaaaganatgactccgaaagcatcgcctatctgacagtaanacgaacgacgacgaacggaaacgaaccggaaacggaacacgacgtaccgttacttaacgtttacgttaggtttagggtttaaggggtttaacgtttttaagttaggttttagggtaggtttagtaaacttaacgttaaaccttaacccgttacgtttacgacgttaacggtacggaccgtacggtaccgtcggtccgtccgttcg

SEQ ID NO: 353410 - DNA, 780 bp, Homo sapiens
  misc_feature: GZ8MTXP02G88R9.4.33.C11.1.454.CMB.2.raw
  modified_base (259)..(259): a, c, t, g, unknown or other
  misc_feature (259)..(259): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgacaagtccagccagagtgtatatacagctacaacatgagaactnttagcttggatcagcaagaaaccaggacagcctacgtaagctgccttacgtacgtttacccggggactacggtaccgttaacccccggggaagttcccccggggtaccctaggtacgtccgtaagttccgaaggttcgggaccacggggtccgggttcgtacgggaacgtaggttactttacccgtaccttaccgtacccgtaacccgtacgttaccaacggtacccgtaacggtcccgttacggaccgtaacgggtacccgttaaaggtaaaaacgttcgggtttacgggtaaccgtttaacggtttttaaacgttaccgttacggttaacccgtaaggttaaccttaaaacggtttacctttaaccgttaacccgtttaaccgttacccgggtttaccgggttaacccggttttaccgggggaacggggttaaccggggtaaaccggttaacggggttacggtaaacggtaacgttaaacccggtaaaacggttaaaccggttcggggtttaaacccgg

SEQ ID NO: 353411 - DNA, 616 bp, Homo sapiens
  misc_feature: GZ8MTXP02HHT6W.4.33.C11.1.454.CMB.2.raw
  modified_base (290)..(290): a, c, t, g, unknown or other
  misc_feature (290)..(290): n is a, c, g, or t
  modified_base (317)..(317): a, c, t, g, unknown or other
  misc_feature (317)..(317): n is a, c, g, or t
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttaattttaaaaggtgtccaatgtgaggtgcagctgggtggagtcgtgggggagcttggccagccgagggccgtccctgagacctctcctgtacagcgttctggattcaactttcgngtatttatgccatgaacgtgggtcccncgaggctccgaggggagggctggagtgggtagtttcattagngcagtggcttagngcgtagggaacagagaactaccggccgtgtctaggtaaggaaaggcagtattcatcattcacgaaagagatgtaacttacccgaaacggctaacgtccgtaccttaatccgtagacctaagtaacgacgaaacgtacgaccgtaaaggaaccgaaccggacggaaccaacgaccgtaccgttacttaagttaaccgtaggttaggtttaacgggttaagttttacggttagtttttaggtaagg

SEQ ID NO: 353412 - DNA, 613 bp, Homo sapiens
  misc_feature: GZ8MTXP02F615P.4.33.C11.1.454.CMB.2.raw
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccgagggccggtccctgagactctcctgtacagcgtctggattctaactttcgtgattatgccatgaactgggtccgccaggctccgaggggaacggggctgggaggtggggttaggtttcagttagngtccagtggtcttancgcgtaggggaacaaacgagaaatcggccgcgtctggtagaaaggcagtattcatcatctacaaagagatgaacttccaaacggtcaacttccgaccttatcctagacagaagtcgaaacagacctaggaaacgaccgaaggaccacgaggcccgttacttacgttacgttaggttaggtttaaggggttaagtttttaacggttagtttttagggaagttggtaactttactttaaacccg

SEQ ID NO: 353413 - DNA, 557 bp, Homo sapiens
  misc_feature: GZ8MTXP02G4ANW.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgaagaactactagcttggtatcagcaagaaaccaggacagcctctaagctgctcattaccggcagcctaacccccggggaatcccggggtccctggacgcgtattccgagtggcaggcgggtctgggacagtattcactctcaccatcagcacgcctgacaggctagaagatggtgactaggtttacttacgtgtacagtactaaattacttaccttactaccttccgtacggtaccgtttccgggacggtaacgggtaacccgaaagggtacggaagtaacgtaaccgtaaaacggaacgttgg

SEQ ID NO: 353414 - DNA, 678 bp, Homo sapiens
  misc_feature: GZ8MTXP02G7Y9N.4.33.C11.1.454.CMB.2.raw
  modified_base (387)..(387): a, c, t, g, unknown or other
  misc_feature (387)..(387): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaggtgtccaatgtgaggtgcagcgtggtggaggtcgtggggggaggtcttgggtccaggcccgaggggccggtccctgagctctcctgtacagcgtctggattcaactttcgtgtatttatcgccatgaaccgtgggtcccgccgaggccgtccgaaggggaagggcgtgggaggtgggttagttcagttagagccagtggtcttagngcgtagggaacacgagaacgtaccgccgcgtctagtacggaaagctaagtattacatacaattccaagaaagaagtataggtaacttacccgaaacgggtccacgttccgacccttaatccggttacgacgaagtaacgtaacgaaacgacgtaaccgtaaacggaaaaccggaaaccggaacggtaaacccgaacgtaaccggtacccgttaacgttaaacgtttaacggtttgggttaaacgggtttaacgggtttaagttttaacggtttaggttttaagggtaacgg

SEQ ID NO: 353415 - DNA, 648 bp, Homo sapiens
  misc_feature: GZ8MTXP02I4TIJ.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcggtccctgagactctcctgtacagcgtctggtattctaactttcgtgtatttatgccatgaacgtggggtcccgccgaggcctccggaaggggaaggggcgtgggtaggttggggtagtttcagttagagcctagtggtacttagtcgcgtagggaacaacgagaaataccggccgcgttctgtagaaaggcagtatacatcatctacaagagatagtaacttacccgaacggtcctaacgttcccgtacccttaactcgttacgaccgtaagaagtacgaaaccgacgtacccgtaaggaaaccggaccggaacggaaccgaacgaccgtacccgttacttaacgtttaacgttaggtttacggtttaagggttaacgtttttacggttagtttttaggggtaagg

SEQ ID NO: 353416 - DNA, 561 bp, Homo sapiens
  misc_feature: GZ8MTXP02F7BP9.4.33.C11.1.454.CMB.2.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (463)..(463): a, c, t, g, unknown or other
  misc_feature (463)..(463): n is a, c, g, or t
  modified_base (479)..(479): a, c, t, g, unknown or other
  misc_feature (479)..(479): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccagggcggtccctgagactctcctgtacagcgtctggattcaactttcgngatttatgccatgaactgggtccncaggctcgaggggagggctgggagtgggtagtttcagttagagccagtggcttagtgctagggacacgagaaactaccgccgcgtctggtagaaagggcagattcgatcatctacaagagatgaacttcccgaaacggctaacgtcgacccttancctgacagatagaacncgcctagaacgaccgaggaccacgacgtccgtattaactcgtggttacggttagggtagttttacggtagtttttggtaagg

SEQ ID NO: 353417 - DNA, 592 bp, Homo sapiens
  misc_feature: GZ8MTXP02G6A4N.4.33.C11.1.454.CMB.2.raw
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (401)..(401): a, c, t, g, unknown or other
  misc_feature (401)..(401): n is a, c, g, or t
  modified_base (442)..(442): a, c, t, g, unknown or other
  misc_feature (442)..(442): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccagggcggtccctgagactctcctgtacagcgtctggattcaactttcgngattatgccatgaactgggtccnccgaggctccgaggggagggctggagtgggtaggttcagttagagccagtggcttagtgcgtagggaacacgagaaactaccggccgtccgtnttaggagggaaaggcaaggtattccatccattcccggaaanaagagagtagtacgtaccgaacgacacgtacgtacctactctcgacgagagacgaacgacgacgacgaacgaaccgaacgaaccgacgacgtaccgtacttacgttaacgttagttaggttaggttaggtttacggtttagtttaggtag

SEQ ID NO: 353418 - DNA, 611 bp, Homo sapiens
  misc_feature: GZ8MTXP02HXJ5Z.4.33.C11.1.454.CMB.2.raw
  modified_base (252)..(252): a, c, t, g, unknown or other
  misc_feature (252)..(252): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgacaagtccagccagagtgttatatacagctaccaaanaatgaagaactacttagcttaggatcagcaagaaaccaggacacgccctacgtaagctacgctacgtaacgtttacccgggacacggtacccgtaacccccggggaacgttcccccggggtaccctaggacgtccgtattcgaggtcggcagggtccggggtctagggactagtatttccactctacacctatcagcacgctgacgaggctaggaagtacgtggtaggtactagtttatacgtgtacgaagactaaatttacttacttaccttaaccttccgttaccggtacgtttaccgggacggtaacgggaacccgtaagggtacggaacgtaacgtaaccgaaacgtaacgtcgg

SEQ ID NO: 353419 - DNA, 633 bp, Homo sapiens
  misc_feature: GZ8MTXP02JYDBF.4.33.C11.1.454.CMB.2.raw
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccagggcggtccctgagactctcctgtacagcgtctggattcaactttcgtgattatgccatgaacgtgggtcccnccgaggctcgaggggaaggggctggagtgggtagtttcagttagngccagtggcttagtgcgtggggacacgagaaactaccgccgcgttctaggtagaaagggcaagtacttcaattcatctacaaagagtatagaacttacccgaaacggctactccggtacccttaatcctggaccaggataggaaaccacgtacccgtaggaaaaccggaaccggaacgggtaaaccaaccgacggaccccggttacttaacgttaaccgttgggttacgggtttaacgggggtttaagtttttacggtttaaggtttttacggggaagg

SEQ ID NO: 353420 - DNA, 551 bp, Homo sapiens
  misc_feature: GZ8MTXP02IA37F.4.33.C11.1.454.CMB.2.raw
  modified_base (264)..(264): a, c, t, g, unknown or other
  misc_feature (264)..(264): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagcccagggcggtccctgagactctcctgtacngcgtctggattcaactttcgtgattatgccatgaactgggtccnccaggctccaggggagggctggagtgggtaggtttcattagngccatggcttatgctgggacacngaaatacgccgcgtctgtagaaaggcagattcatcatctacaagagatgattacccgaaacggctatccgcctatctgcagatagaacagcctagaaacgaccggaacgggaacacgacgtaccgtaccttattaacgtggtagtttacggggtagttttacgtagtttttggtaagg

SEQ ID NO: 353421 - DNA, 524 bp, Homo sapiens
  misc_feature: GZ8MTXP02JZPQB.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagtgttatatacagctccaacaatgagaactacttagcttggtatcagcagaaaccaggacagcctcctaagctgctcactttaccggcacgccgtaccccggggaatcccggggtcctgacgcgattcgagtggcgagcgggtctgggacagtatttcactctcacactcagcacgcctgcgacgctaggagagtggtgactaggtttatactgtcagcaatactactactactcctcggtacgttcggcggtacggaaccgaaagggtcgaagacgtacgaaacgtacgtagg

SEQ ID NO: 353422 - DNA, 552 bp, Homo sapiens
  misc_feature: GZ8MTXP02JIF1R.4.33.C11.1.454.CMB.2.raw
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (385)..(385): a, c, t, g, unknown or other
  misc_feature (385)..(385): n is a, c, g, or t
tcagagcactgtagcacgaccggtgctcgatttagagtgagctcgttgggtttgggcttagctgggttttccttgttgctattttaaaaggtgtccaatgtgaggtgcagctggtggagtctgggggaggcttggtccagccagggcggtccctgagactctcctgtacagcgtctggattcaacttttcgtgattatgccatgaactgggtccgccaggctccgagggaagggctggagtgggtagtttcattagancatggcttangctggacaacagaatacgccgcgtctgtagaaaggcagattcatcatctacaaagagatgacttccgaaacggcatcccgctatctgcagatgaacagcctagaataccgagacacngccgtatattactgttagttagggtagtttacgtagtttgagtagtatattactaccctattgactacgtgggacacggtacctggtcgtccgtctcctacacgtccctacaccgaacggccctacgtccggtcccttccccgtcgcccgccctcgtcctacgacgg

SEQ ID NO: 353423 - DNA, 587 bp, Homo sapiens
  misc_feature: GZ8MTXP02F5A15.4.33.C11.1.454.CMB.2.raw
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
  modified_base (489)..(489): a, c, t, g, unknown or other
  misc_feature (489)..(489): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcggtccctgagctctcctgtacngcgtctggattcaactttcgnattangaccatgaactgggtccncaggcctccgaggggagggctggagtgggtagttcagttagagtcagtggcttagngcgtagggacacgagaactaccgccgtgtacgtggtaggaaaacggcaagtatttacattcaatcctaagaagagtatgaacttacccgaaaggctattccgaccttatcctgacagatggaaacncgacctaggaaacgaccggaaggaccacgacgtcccgttattaacgttaacgttggttaggtttacgggttaagtttttacggttagttttgggtaag

SEQ ID NO: 353424 - DNA, 559 bp, Homo sapiens
  misc_feature: GZ8MTXP02IMWAJ.4.33.C11.1.454.CMB.2.raw
  modified_base (454)..(454): a, c, t, g, unknown or other
  misc_feature (454)..(454): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagtgttatatacagctaccaacaatgaagaactacttagcttggtatcagcaagaaaccaggacacgaccctactaagctgctacacgtttaccgggcacggaccgtaaccccccggggaacgtcccggggtccctaggacgcgtattccgaggtcggcgaggcggggtcgtaggggacagtacttccactctacaccatcagcacgcctgcacggctagaagtntggtgactagtttactactgtacagtactaattacttactactacctccgtacggtacgttcggacggaggaaccgaggtaggacgactacgaaacgtacgtcgg

SEQ ID NO: 353425 - DNA, 500 bp, Homo sapiens
  misc_feature: GZ8MTXP02GCCV1.4.33.C11.1.454.CMB.2.raw
  modified_base (231)..(231): a, c, t, g, unknown or other
  misc_feature (231)..(231): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (469)..(469): a, c, t, g, unknown or other
  misc_feature (469)..(469): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccacatcaactgcaagtccagccagatgttanatcagctcaaacaatgaagaactactagcttggtatcagcagaaaccaggacagcctactaagctgctctacgtttaccgggcaggcctacccccggggaactcccgggggtccctgacgcgtattcgagtggcagcggtctgggacagtatttcactctcaccagtcagcagcctgcaggctgaagntgngctagttatactgtcagcaatacttctactacgtctacgacttcggngtagggaacgaggtagagatacaacgactgg

SEQ ID NO: 353426 - DNA, 549 bp, Homo sapiens
  misc_feature: GZ8MTXP02G9IX6.4.33.C11.1.454.CMB.2.raw
  modified_base (237)..(237): a, c, t, g, unknown or other
  misc_feature (237)..(237): n is a, c, g, or t
  modified_base (333)..(333): a, c, t, g, unknown or other
  misc_feature (333)..(333): n is a, c, g, or t
tcagagcactgtagcacgaccggtgctcgatttagagtgagctcgttgggtttgggggagtgtgaggggacatgagtggtagaaacagtggatatgtgtggcagtgtctgaccttggttgttttttgtttgtaggtgtccaatgtgaggtgcagctggtggagtcgtgggggaggcttggtccagccagggcggtccctgagactctcctgtacagcgtctggattcaacttttcgngattatgccatgaactgggtccgcaggctcgagggagggctggagtggtagtttcattagagccatggcttatgctgggacaacagaatacgccgngtctgtagaaacggcagattcatcatctcaaagagatgaacttccaaacggcatccgcctatctgacagatagaacagacctagaacgaccgaggacacgagccgtactaattacgtggtagttagggtaagttttacgtatttttaggagttgtattagttactaacccctacttcgacttaacgtcgggacgacgggaacctcggtacgccgtc

SEQ ID NO: 353427 - DNA, 576 bp, Homo sapiens
  misc_feature: GZ8MTXP02I0ONX.4.33.C11.1.454.CMB.2.raw
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggagcttggtccagccgagggcgtccctgagactctctgtacagcgtctggattcaactttcgngtattatgccatgaactgggccncgagctcgagggagggctggagtggtagttcattaganccagtggtcttangcgtggaacacgagaaataccgccgcgtcgtaggtagaaagcagtattacatcattcaacaagtagagtagtaacttaccgaacggactatccgacttatccgtgacagatgaaacgagaccgtagaacggaccggaacgaccgaacgacgtaccgttacttaacgttaacgttggttagggtttacgggttaagttttaacgttggtttttaggtaagg

SEQ ID NO: 353428 - DNA, 535 bp, Homo sapiens
  misc_feature: GZ8MTXP02FUOZW.4.33.C11.1.454.CMB.2.raw
  modified_base (236)..(236): a, c, t, g, unknown or other
  misc_feature (236)..(236): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttanatacagctccaacaatgagaactacttagcttggtatcagcagaaaccaggacagcctcctaaagctgctcatttaccgggcacgccgtaacccccgggaatcccggggtcctgacgcgtattccgagtggcagccgggtntgggacagntttcactctcaccatcagcagcctgacgagctagagatggtagctagtttactatgtcagctaaatacttctactactccgtacggtacgtttacggcgggtaacggtaaccgaaaggtggaacgacgtaacgaaaacgtacgttaggg

SEQ ID NO: 353429 - DNA, 660 bp, Homo sapiens
  misc_feature: GZ8MTXP02IKMD4.4.33.C11.1.454.CMB.2.raw
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtggggcgaggacgggccaccatcaactgacaagtccagccagagtgttanatacagctacaanatgaagaactattagcttaggatcagacaagaaaccaggacacgcctactaagctgcctacgtacgttaccgggacacggtcccgtaaaccccccggggaacgttcccccggggtaccctaggacggtaccgtacttccggaacggcgggaccgtagggggtcccgggggtctacgggggaaaccagttacttaccgaaccttccgtaccaaccctagtaccaacgccgaacgcccgtagaccgaagggtaccgtaaggaaaggtgtgggtacggacctttaaggtttattaccgtgtacctaagactaaattacttacttacctacttccgtacggtaccgtttcgggaacgggtacgggaaacgtagggtacggacgtaacgtaaccgtaaaacgtacgtagg

SEQ ID NO: 353430 - DNA, 587 bp, Homo sapiens
  misc_feature: GZ8MTXP02GQSF9.4.33.C11.1.454.CMB.2.raw
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
  modified_base (370)..(370): a, c, t, g, unknown or other
  misc_feature (370)..(370): n is a, c, g, or t
  modified_base (400)..(400): a, c, t, g, unknown or other
  misc_feature (400)..(400): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctgggtggagtcgtgggggagcttggccagccgagggcggtccctgagactctcctgtacagcgtctggattcaactttcgngattatgccatgaactgggtccnccgaggcctacgaggggaggggctgggagtgggtagtttcagttagagccagtggcttangcgtaggaacagagaataccgccgtcgtcngtagaaagcaagattacatactatcctagaaagagatagtaacttacccgaaacggtcatccgacccttaatcctaggacaaggaatacggaaactaggacccgtaaggaaacggaaccggaacggaaccacgacgcccgtattaataacgttgtaggtttaggtacgttttagtagttttaggtag

SEQ ID NO: 353431 - DNA, 578 bp, Homo sapiens
  misc_feature: GZ8MTXP02F6ISL.4.33.C11.1.454.CMB.2.raw
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
  modified_base (442)..(442): a, c, t, g, unknown or other
  misc_feature (442)..(442): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcggtccctgagactctcctgtacagcgtctggattcaactttcgtgatttatgaccatgaacgtggggtcccnccgaggcctccgaggggaaggggctgggagtgggtaggtttcagttagagccagtggacttagngcgtagggacacgagaactaccggccgtcgtcgtaggtagaaaggcaagtattacatcatcctanaagagatgtaacttaccgaacggcatccgtacctatctgacagatagaactagcctagaacgacgaggacacgacgccgtattacgttaacgttaggttacggtttagggttagttttacgttagttttaggtaag

SEQ ID NO: 353432 - DNA, 622 bp, Homo sapiens
  misc_feature: GZ8MTXP02IF9WZ.4.33.C11.1.454.CMB.2.raw
  modified_base (197)..(197): a, c, t, g, unknown or other
  misc_feature (197)..(197): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (438)..(438): a, c, t, g, unknown or other
  misc_feature (438)..(438): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttggcttagctgggttttcctgttgctattttaaaaggtgtccaatgtgaggtncagctgggtggagtcgtgggggagtcgttggtccagccgagggcggtccctgagactctcctgtacngcgtcnggattcaactttcgntattangccatgaacgtgggtcccncgaggcctcgaggggacgggctggaggttggggtagttcagttagagctagtggtcttagtgcgtagggaacaacgagaactaccgggccgtcgtcgtagtagaaaggcagtattcatcattcctaanaagagatagacttacccgaaacggctagtccgacctatcgtagcagaactagaacgacgacccgtaggaaaacgacccggaaacgggaaaccaacgtaccgtacccgttatttaaacgttaacgtttggttacgggttttaacgggttacggtttttaacggtttaacgtttttagggtaaagg

SEQ ID NO: 353433 - DNA, 559 bp, Homo sapiens
  misc_feature: GZ8MTXP02HY98C.4.33.C11.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
  modified_base (346)..(346): a, c, t, g, unknown or other
  misc_feature (346)..(346): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgacaagtccagccagagttgttatatacagctaccaanaatgaanaactacttagcttggtatcagcaagaaaccnggaacagcctactaagctgctcagttaccggnagctaccccggatcccgggtccngagcgattcgagtgcagcgtcgagggacagtacttcactcgtacaccatcagcacgcctagcaggctagaaagntggngacttaagtttatacgtgtaccagtactaaatttacttctaactaaccttccgtacggttaaccgtttcgggaacgggtaacggtaacccgaaaggttacggaaacgtacgttaaacccgaaaagttaaccgtgg

SEQ ID NO: 353434 - DNA, 566 bp, Homo sapiens
  misc_feature: GZ8MTXP02JO15L.4.33.C11.1.454.CMB.2.raw
  modified_base (312)..(312): a, c, t, g, unknown or other
  misc_feature (312)..(312): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (503)..(503): a, c, t, g, unknown or other
  misc_feature (503)..(503): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggcttggtccagccaggggcggtccctgagactctcctgtacagcgtctggattcaactttcgtgatttatgccatgaactggggtccnccaggcctcgaggggagggctggagtgggtagtttcagttagagcatggcttangctgggacacgagaactcgccgngtcngtagaaagcagattcatcatctacaagagatgattcccaaaggctatcgcctatccgtgacagactagaacagacctaggaaacgaccggaaggaccaacgacgccgttntaaacgtttaacgtcggtttaggttaggggttaacgtttttacggtaagtttttgggtaacgg

SEQ ID NO: 353435 - DNA, 554 bp, Homo sapiens
  misc_feature: GZ8MTXP02HPMXS.4.33.C11.1.454.CMB.2.raw
  modified_base (185)..(185): a, c, t, g, unknown or other
  misc_feature (185)..(185): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
  modified_base (477)..(477): a, c, t, g, unknown or other
  misc_feature (477)..(477): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtntccaatgtgaggtgcagctgggtggagtcgtgggggagcttggtccagcccagggcggtccctgagactctcctgtacagcgtctggattcaacttttcgngatttatgccatgaactgggtcccnccaggctccgaaggggaggggctggagtgggtaggtttcatttagagccatggcttangctgggaacacagaaataccggccgcgtctggtagaaaggcaggattacatctatctacaaagagatgattacccgaaacggctaatcgacctaatccgtgacagaanagaacacgacacgaacgacgacgacacacgctactataacgttgttaggttaggttagtttacgttagtttaggtag

SEQ ID NO: 353436 - DNA, 761 bp, Homo sapiens
  misc_feature: GZ8MTXP02JHPVU.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttaattttaaaaggtgtccaatgtgaggtgcagctgggtggagtcgtgggggaggtcgttggtccaggccgaggggccggtccctggacgactctcctgtacagtcgtctggattctaactttcgtgtaatttatcgaccagtcgaaccgttcggggtccccgccgagggcctacccggaagggggaacggggtcgtaggggtagggttgggggtttacggttttcaagtttaggacgtaccagtcgggtactttagtgtcgtaggggaacacgaagaaactaccgcccgtgttacgtggtaaggaaaacggctaaaggtacttacgatactattcctaaacgaaaggaagtaacgttacgtaacctttacccggaaacgggtacctacgtacccgtacccttaactccgtacgaccgtaacggtagtaaccgaaaccgtaacgacccgttaaaagggaaaacccggaaacccggtaaacgggaaaccaaaccggtaccggtaccccgttatttaacgttaacggttaggtttaacgggtttaacgggggtttaagtttttaaccggtttaggtttttacggggtaagg

SEQ ID NO: 353437 - DNA, 568 bp, Homo sapiens
  misc_feature: GZ8MTXP02GNEH2.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagtgttatatacagctaccaaacaatgaagaactactagcttggtatcagcaagaaaccaggacagcctacctaagctgctactaacgtttaccgggacaagccgtaaccccccggggaaacgtcccgggggtacccctaggacgaccgattccgaggtggcagggccgggtcgtggggacagtatttcactcacacatcagcagtccagcgacgacgtagaagaagtggtagtacgtagtttaatttactagtacagataaatacttactactactacctacgtacgttacggtacggacggaacgaacggtaggagagtacgaaacgaacgtacgg

SEQ ID NO: 353438 - DNA, 696 bp, Homo sapiens
  misc_feature: GZ8MTXP02I7CJD.4.33.C11.1.454.CMB.2.raw
tcagagcactgtagcacgaccggtgctcgatttagagtgagctcggttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagagtgttatatacagctaccaaacaatgaagaactacttagcttggtatcagcaagaaaccaggacagcctctaagctgctcacgtttaccggggcacggccgtaacccccggggaacgtcccggggtaccctaggacgaccgatttccgaggtcgggacgacgggccggggtacgtagggggaacctaaggtactttaccgaccttacctaccgtaaccctaatcccgaaggcccgtaacggccccgttggaccgacgggtaccgttaacggaaggtaagtcggggttacggtaccgttaaggtttttaacttaccgttagggttacccaaggtacctaaaagtttacctttacgttaaccttaccgttacccgttacggttaccgtttaccgggggacggggtaacgggtaaccgtaaggggttacggaacgaacgtaaccggtaaaacggtacgttaacggg

SEQ ID NO: 353439 - DNA, 577 bp, Homo sapiens
  misc_feature: GZ8MTXP02I40Y6.4.33.C11.1.454.CMB.2.raw
  modified_base (372)..(372): a, c, t, g, unknown or other
  misc_feature (372)..(372): n is a, c, g, or t
  modified_base (436)..(436): a, c, t, g, unknown or other
  misc_feature (436)..(436): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtgggggagcttggtccagccgagggcgtccctgagactctcctgtacagcgtctggattcaactttcgtgattatcgccatgaacgtgggtcccgccgaggctaccgaggggagggctggaggtgggtagtttcagttagagccagtggtctttangcgtagggaacacgagaaactaccggcccgtcgttcgtaggtagaaagcagattcatcatctanaagagatgattaccgaaggctatccgctatcgtgcagatgaaacgcgacctagaacggaaccgaggaaacacgacgaccgttacttaagttaacgtggtttaggttaacgggttagtttttaacggtagttttaggtaagg

SEQ ID NO: 353440 - DNA, 539 bp, Homo sapiens
  misc_feature: GZ8MTXP02G97CO.4.33.C11.1.454.CMB.2.raw
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (363)..(363): a, c, t, g, unknown or other
  misc_feature (363)..(363): n is a, c, g, or t
  modified_base (423)..(423): a, c, t, g, unknown or other
  misc_feature (423)..(423): n is a, c, g, or t
  modified_base (491)..(491): a, c, t, g, unknown or other
  misc_feature (491)..(491): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtgggggaggcttggtccagccagggcggtcctgagactctcctgtacagcgtctggattcaactttcgngattatgccatgaactgggtccncnggctccgagggagggctggngtggggtagttcagttagagccagtggcttagngctggggaacacgagaaatccggccgcgtctgtagaaaggcagatcatcatctacaaganatgatccaacgcactcgctatctgcagatgaactgaccgtagaacggacgacggacacgacgcccgtntaacgttcgtgttacgttagggtagtttacggttagttttaggtaagg

SEQ ID NO: 353441 - DNA, 608 bp, Homo sapiens
  misc_feature: GZ8MTXP02HKH5G.4.33.C11.1.454.CMB.2.raw
  modified_base (242)..(242): a, c, t, g, unknown or other
  misc_feature (242)..(242): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggccaccatcaactgacaagtccagccagagtgttanatacagcctaccaaacaatgaacgaactacttagcttaggtatcagacaagaaaccaggacacgcctactaagctgctacgtacgttaccggcacggtaccgtaccccccggggaacgtcccggggtaccctaggacgccgtattcgaggtcggacgaggggtccggggtcgtaggggacctagtactttaccgactcctacacccatcgacgccacgtcccgtaggacgacggtacgtaggtaaagtgttacgggtagtacgttaagtttacgtacgtgtacagtactaattactactacgtacctccgtacggtacgttcggacggacggaacgtaggtacggacacgtacgaaacgtacgtgg

SEQ ID NO: 353442 - DNA, 564 bp, Homo sapiens
  misc_feature: GZ8MTXP02HA2OY.4.33.C11.1.454.CMB.2.raw
  modified_base (454)..(454): a, c, t, g, unknown or other
  misc_feature (454)..(454): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtggggcgaggacgggccaccatcaactgacaagtccagccagagttgttatatacagctaccaaacaatgaagaaactacttagcttggtatcagcaagaaaccaggacagcctactaagctgctcacgtttaccgggcacgccgtaacccccggggaagtcccggggtaccctggacgcgattcgaggtggacaggcgggtcgtgggaactagtatttaccactctacaccatccagacacgcctgacgaggcgtagaagtntggtaggacttagtttattacgtgtacagtactaattacttactacttacctccgtcgtacgttcgggacggtacggaacgaaggtaggacgatacgaaacgtacgtagg

SEQ ID NO: 353443 - DNA, 611 bp, Homo sapiens
  misc_feature: GZ8MTXP02FN3BH.4.33.C11.1.454.CMB.2.raw
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggccagccgagggcggtccctgagactctcctgtacaacgtctggattcaactttcgngattatgccatgaactgggtccnccaggctccgaggggaaggggctgggaggtgggtaggtttcattagagccatcggcttagngcgtggggacaacagaatacgccgtacgtctgtagaaagcagtattcatcatctacaaagagatgaacttaccgaaacggcaacgtccgacccttagtactcggaccaggactagaaacgacgtcccaaggaacgacccgggaaggaaccaacgacgtacccggttactaaacgtttaaccgtgggttaggtttaaggggttacgtttttaacggtttaggtttttacgggaaggttttaagg

SEQ ID NO: 353444 - DNA, 627 bp, Homo sapiens
  misc_feature: GZ8MTXP02I9PM1.4.33.C11.1.454.CMB.2.raw
  modified_base (262)..(262): a, c, t, g, unknown or other
  misc_feature (262)..(262): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgagacgggccaccatcaactgacaagtccagccagagtgttatatacagctaccaacaatgaanaactactagcttaggtatcagacaagaaaccaggacacgcctacaagctgctactacgttaccggcacggtccgtaacccccggggacgtcccggggtaccctaggacgcgtacttcgaggtcggacgacgggtccgggtcgtaggggactagtactttacgacctcctaccaacccatccacgccacgccgtacgaccgaggtaccgtaaggaacgtagttgggtagtacgttaagtttacttacgtgtacgagtactaattacttacctaacctaccgttccgtacggttaccgttaccggggacggtaacggggtaaccgtaaaggggtacggaacgaacgtaaccgaaaacgtacgtacgg

SEQ ID NO: 353445 - DNA, 634 bp, Homo sapiens
  misc_feature: GZ8MTXP02I1CM0.4.33.C11.1.454.CMB.2.raw
  modified_base (265)..(265): a, c, t, g, unknown or other
  misc_feature (265)..(265): n is a, c, g, or t
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
  modified_base (442)..(442): a, c, t, g, unknown or other
  misc_feature (442)..(442): n is a, c, g, or t
  modified_base (486)..(486): a, c, t, g, unknown or other
  misc_feature (486)..(486): n is a, c, g, or t
  modified_base (503)..(503): a, c, t, g, unknown or other
  misc_feature (503)..(503): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggagcttggtccagccgagggcggtccctgagactctcctgtacngcgtctggtattcaactttcgtgtattatgccatgaactgggtccnccgaggctccgagggagggctggagtgggtgtttcagttagagccagtcggctttagngtctaggggacaacgagaaacttaccggcccgtgtcgtaggtacggaaaagggcagtattcatacatacctanaagagatgacttacccgaaacggctaagtccgtcctaattccgngcaagtactacgaaacncgtaacccgtaggaaaacggacccggaagggaaaccaaccgtaacgaccccgttattaaacgttaaccgttagggttacggtttaaacgggggtttacgtttttaacggttaggtttttagggttaacggg

SEQ ID NO: 353446 - DNA, 657 bp, Homo sapiens
  misc_feature: GZ8MTXP02FKQ0F.4.33.C11.1.454.CMB.2.raw
  modified_base (310)..(310): a, c, t, g, unknown or other
  misc_feature (310)..(310): n is a, c, g, or t
  modified_base (374)..(374): a, c, t, g, unknown or other
  misc_feature (374)..(374): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtgggggagcttggtccagccgaggggccggtccctgacgactctcctgtacagcgtctggtattcaactttcgtgattatgccatcgaacgtcgggtccnccaggctaccgagggggaagggctgggaggtggggttaggttcagttagagccatgggtcttancggcgtagggaacaacgagaactaccgcccggcgtcgtaggtagaaaaggctaggtacttacattcatacctagaaagtagattagtaaccttaccgaaacgggtcctaacgtcccgtacttactcgtacgacgaagtacgtaacgaaacgacgtaccgaggaaacgaccgggaagaaccacgacgtacccgttgttaaaccttacgttacgggttaggtttacgggttaaggtttttacgttagtttttaggggagttacggtaattaacgtttaaaccccg

SEQ ID NO: 353447 - DNA, 562 bp, Homo sapiens
  misc_feature: GZ8MTXP02FGTPW.4.33.C11.1.454.CMB.2.raw
  modified_base (234)..(234): a, c, t, g, unknown or other
  misc_feature (234)..(234): n is a, c, g, or t
  modified_base (315)..(315): a, c, t, g, unknown or other
  misc_feature (315)..(315): n is a, c, g, or t
  modified_base (404)..(404): a, c, t, g, unknown or other
  misc_feature (404)..(404): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttanatacagctcaacaatgagaactactagcttggtatcagcaagaaaccaggacagcctcctaagctgctcagtttacccggnagcctacccccggggaagttcccggggccctggaacgccgattccagtcggcagcggtctggggaccagtaatttcactctcaaccacncacgcacgcgcgcgagacgagaagagtaggtgtacgtagtttaacgttacgtacgtacgacgtactaactaacttactacctacctaccgtaccggtaccgtacggtacgggacgggaaccggaacggtacggacgaacgtaacgaaacgaacgtacg

SEQ ID NO: 353448 - DNA, 835 bp, Homo sapiens
  misc_feature: GZ8MTXP02G10OQ.4.33.C11.1.454.CMB.2.raw
  modified_base (264)..(264): a, c, t, g, unknown or other
  misc_feature (264)..(264): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggagcttggtccagccgagggcgtccctgagactctcctgtacngcgtctggattcaactttcgtgattatgccatgaaccgtgggtcccgccgaggcctaccggaaggggaaggggctaggggagggttggggttaggtttcgaagtttaggacggtccaagttgggtactttagtggccgttaggggaaaccaacgaaggtaaacgttacccgggcccgtaccgttcgtagggtacgggaaaaacgggcctaaaggtaactttcaaacgtacctaacgtccttaaccgaaaaggtaacgtaagttacggtaaaccgttaccccgaaaaccggggtcctaaacgttccccggtaccctttaacgttcccgttacggaccgtaaacgggtaagttaccggtaaaaccgaccgggtaacccgtaacggggtaaaacccgggaaaccccggggaaaacggggaaacccaaacccggtaaccggtacccccgggtttaactttaaacggttttaacccggtttacgggggtttttaacggggtttttaaaacggggggtttaaaggtttttttaaccggggtttttaaacgggtttttttacgggggttaaaacgggg

SEQ ID NO: 353449 - DNA, 631 bp, Homo sapiens
  misc_feature: GZ8MTXP02ISM7N.4.33.C11.1.454.CMB.2.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (381)..(381): a, c, t, g, unknown or other
  misc_feature (381)..(381): n is a, c, g, or t
  modified_base (463)..(463): a, c, t, g, unknown or other
  misc_feature (463)..(463): n is a, c, g, or t
tcagagcactgtagcacgaccggtgctcgatttagagtgagctcgttggggttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacggccaccatcaactgacaagtccagccagagttgttatatacagcctacaanaatgaanaacttactagtcgttaggatcaagacgaagaaaaccgnggaacacgtaccctactaagctgccttcgaaccgtttaccggggnaacgcccgtaaccccggggaacgtccccggggtccnggagtccgtattcgagtggcgacggtccggggtctagggggactagtacttacactcacaccatcagcagcctgacgacggntaagaagtgttaggtacggtacttagtttaagttaccgtatactaagaacttaaattacttacctaaccttaccgttcccgttacggttacggtttaccggggaacgggtaacgggtaacccgtaaagggggtaggaaacgtaacgaaacgtaaaacgtaacgttcgg

SEQ ID NO: 353450 - DNA, 565 bp, Homo sapiens
  misc_feature: GZ8MTXP02I6Q0T.4.33.C11.1.454.CMB.2.raw
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (464)..(464): a, c, t, g, unknown or other
  misc_feature (464)..(464): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttcctgttgctatttaaaggtgtccaatgtgaggtgcagctggtggagtcgtgggggagcttggtccagccagggcgtccctgagactctcctgtacagcgtctggattcaacttttcgngatttatgccatagaacgtgggtccnccaggctccgaggggagggctggagtgggtagtttcattagagccagtggcttangctagggacacgagaaactaccggaccgcgttactggtaagaaaaggtcaagtacttcatcaatcctanaaganatgacttaccgaaggcaatcccgactancctgacagatgaacagcctagaaacgaccgacgtaacacacgaccgtactaattaaccgtggttacggttaagggtagttttaaccgttagttttaggaag

SEQ ID NO: 353451 - DNA, 648 bp, Homo sapiens
  misc_feature: GZ8MTXP02IFLFL.4.33.C11.1.454.CMB.2.raw
tcagagcactgtagcacgaccggtgctcgatttagagtgagctcgttgggttggggggagctacaacaggcaggcaggggcagcaagatggtgttgcagacccaggtcttcatttctctgttgctctggatctctggtgccgtacggggacatcgtgatgacccagtctcagctccctggctgtgtctcgtgggcgagacgggccaccatcaactgacaagtccagccagagtgttaatatacagctaccaaacaatgaactaactacttagcttaggtatcagacaacgaaaccgaggacacgccctactaagctcgctctacgttaccgggcacgccgtacccccggggactcccggggtcctggacgcgatcgacggcggacgagggtcgggtcgtcggggaacagttactttccacctctaccaactactaccgacgcgacgccgtgacgacggcgtacggaagtacgttgggttacggtacgtttaacgtttaactttacgtcggtactaacgaaccttaatttaacctttaccttaaccttacccgttacccgttaccgggttaaccggtttaccggggacggggtaaccgggaacgtaaagggtacggaaacgtaacgtaaccgaaaacggtacgtacggg

SEQ ID NO: 353452 - DNA, 754 bp, Homo sapiens
  misc_feature: GZ8MTXP02H4KIM.4.33.C11.1.454.CMB.2.raw
  modified_base (315)..(315): a, c, t, g, unknown or other
  misc_feature (315)..(315): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctgggtggagtcgtgggggaggtcttggccaggccgaggggccggtccctgagactctcctgtacagtcgtctggacttctaactttcgtgtattatgccatgaacgtgggtcccnccgaggcctaccggaggggaaggggtctggggtaggttggggttaggtttacagttaggacgcctaagtcgggtactttagtcgcgtaggggaacaaacgagtaaacgtaccgcccggtacgttactagggtaacgaaagcaaagtacttaccatcaatactacgaaagacgtagtagtaacttacccgaaacggtcctaacgttcccggtaccttaaacgttcgtacgaccgtaaagtatacggaaaccgacggtacccgtaaaggaaaccggacccggaaacgggaaacccaaccggtaacggtacccccgttaaagttaacgtttaaccggttcgggtttaaggggtttaaacggggtttaacggtttttaaacggtttaagttttttacgggggaagtttaccgggttaaattttaaacccgtttaaaacccccg

SEQ ID NO: 353453 - DNA, 669 bp, Homo sapiens
  misc_feature: GZ8MTXP02F8G0X.4.33.C11.1.454.CMB.2.raw
  modified_base (268)..(268): a, c, t, g, unknown or other
  misc_feature (268)..(268): n is a, c, g, or t
  modified_base (373)..(373): a, c, t, g, unknown or other
  misc_feature (373)..(373): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttaattttaaaaggtgtccaatgtgaggtgcagctggtggagtcgtgggggagtcttggtccagccgaggggccgtccctgagctctcctgtacngcgtctggattctaactttcgtgtattatgccatgaacgtgggtccgcaggctacgaggggacgggcgtggagtgggttagttcagttagagccagtggcttagngacgtagggacacgagaacgtacgccgtgtactggtacgaaagctaagtattcattcactacctaagaagtacgtataggtaacttacccgaacgggctaacggtccctaacccttagtaccgtagaacgtagtaacgtaacggaaaccgtacggtaaccgtaaacgggaaacccggaaaccggaaacggaaacccgacgtaccggttacccgttacttaacggtttaacgtttaggggtttaacgggttttacggggtttaacgtttttaacggtttaggttttacggggtaacg

SEQ ID NO: 353454 - DNA, 493 bp, Homo sapiens
  misc_feature: GZ8MTXP02FNW04.4.33.C11.1.454.CMB.2.raw
  modified_base (235)..(235): a, c, t, g, unknown or other
  misc_feature (235)..(235): n is a, c, g, or t
  modified_base (313)..(313): a, c, t, g, unknown or other
  misc_feature (313)..(313): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttanatacagctccaaacaatgagaactacttagcttggtatcagcagaaaccaggacagcctcaagctgctcattaccggnagctaccccgggaatccggggtcctgagcgattcagtggcagcggtctgggacagntttcactctcacatcancagcctgcaggctagaagatgtgctagtttatactgcagctaatactactactactctcggtacttcggcggaggaaccgaggtagacgatacgaaacgacgtacgg

SEQ ID NO: 353455 - DNA, 584 bp, Homo sapiens
  misc_feature: GZ8MTXP02IOZAK.4.33.C11.1.454.CMB.2.raw
  modified_base (264)..(264): a, c, t, g, unknown or other
  misc_feature (264)..(264): n is a, c, g, or t
  modified_base (318)..(318): a, c, t, g, unknown or other
  misc_feature (318)..(318): n is a, c, g, or t
  modified_base (451)..(451): a, c, t, g, unknown or other
  misc_feature (451)..(451): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcggtccctgagactctcctgtacngcgtctggtattcaactttcgtgtatttatcgccatcggaacgtcggggtcccnccgaggcctccggaaggggaggggcgtgggaggtggggttaggtttcagttagagccagtggcttagtgcgtagggaacacgagaactaccgccgtcgtcgtggtagaaaggcagtatcatcatctacaaganatgacttaccgaaaggctagtccgctactctgacagatagaacagcctaaggaacgacgacggacacgacgtaccgttattagttcgttaggttaggttaacgggttgttttaacggttagttttaggtaagg

SEQ ID NO: 353456 - DNA, 595 bp, Homo sapiens
  misc_feature: GZ8MTXP02JQD4T.4.33.C11.1.454.CMB.2.raw
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
  modified_base (463)..(463): a, c, t, g, unknown or other
  misc_feature (463)..(463): n is a, c, g, or t
  modified_base (491)..(491): a, c, t, g, unknown or other
  misc_feature (491)..(491): n is a, c, g, or t
  modified_base (506)..(506): a, c, t, g, unknown or other
  misc_feature (506)..(506): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttaattttaaaaggtgtccaatgtgaggtgcagctgggtggagtcgtgggggagcttggtccagccgagggcgtccctgagactctcctgtacngcgtctggattcaactttcgtgtatttatgccagtgaacgttggggtcccnccgaggcctaccgaagggggaaggggcgtagggaggtggggttaggttcagttagagcctagtcggtcttatggcgtagggaacacgagaaacgtaccggccgtcgttctggtaggaaaacggcaagtattcatcatctacaaganatgactaccaacggcagtccgcctatcngacagaatcgaaacngacctaaggaacgaaccggacggaacacgacgacccgtattaagtaacgtggttacggttagggttagttttacgtaggttttggtaag

SEQ ID NO: 353457 - DNA, 649 bp, Homo sapiens
  misc_feature: GZ8MTXP02HFTBR.4.33.C11.1.454.CMB.2.raw
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
tcagagcactgtagcacgaccggtgctcgatttagagtgagctcgttgggtttgggggagctctgggagaggagccccagccgtgagattcccaggagtttccacttggtgatcggcactgaacacagaccaccaaccatggagtttgggcttagctgggtttccttgttgctatttaaaggtgtccaatgtgaggtgcagctggtggagtagtgggggagcttggtccagccagggcgtccctgagactctcctgtacngcgtctggattcaactttcgngattatgccatgaacgtggggtcccnccgagggcctaccgaaggggaacggggctaggggaggttggggtaggtttcagttagacgcctagtcgggtactttagtcgacgttaggggaaaccaaacgaggtaaactaccggcccgtcgtcgtaggtaggaaaacgggcaagtattacatacatactacaagagatagacttaccgaacggtcactccgaccttatccgtagcagatacgaaacacgacccgtaggaaacggaccggaacggaaccaaccgacggtacccgttacttaacgtttacgtggtttagggtttaaacggggtttacgttttaaggtttaggtttttacggaaggtttaacgg

SEQ ID NO: 353458 - DNA, 619 bp, Homo sapiens
  misc_feature: GZ8MTXP02FYJ4K.4.33.C11.1.454.CMB.2.raw
  modified_base (292)..(292): a, c, t, g, unknown or other
  misc_feature (292)..(292): n is a, c, g, or t
  modified_base (522)..(522): a, c, t, g, unknown or other
  misc_feature (522)..(522): n is a, c, g, or t
  modified_base (529)..(529): a, c, t, g, unknown or other
  misc_feature (529)..(529): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagcttgggttttccttgttgcttaattttaaaaggtgtccaatgtgaggtgcagctggtggagtcgtgggggagcttggtccagccgagggcggtccctgagctctcctgtacagcgtctggattctactttcgtgattangccatgaactgggccgccgaggcctccggaggggaggggtctgggaggttggggttaggtttcagttagacgtccagtggtcttagtgcgtacgggaacacgagaaactaccggcccgtcgttcgtaggtagaaaaggctaagtactttcaaattccaattcctaagaaaaggataagtgtaacctttaccgaaaccggtcaacgttccgaccttatccgtgacagtaanacgaacncgactaacgaacgacgacgacacgtacgaccgttattagttaagttaggttaggtttaacgggtttagtttacggtttagtttaggtacg

SEQ ID NO: 353459 - DNA, 643 bp, Homo sapiens
  misc_feature: GZ8MTXP02JK9DA.4.33.C11.1.454.CMB.2.raw
  modified_base (265)..(265): a, c, t, g, unknown or other
  misc_feature (265)..(265): n is a, c, g, or t
  modified_base (309)..(309): a, c, t, g, unknown or other
  misc_feature (309)..(309): n is a, c, g, or t
  modified_base (361)..(361): a, c, t, g, unknown or other
  misc_feature (361)..(361): n is a, c, g, or t
  modified_base (389)..(389): a, c, t, g, unknown or other
  misc_feature (389)..(389): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggcttggtccagccagggcggtccctgagactctcctgtacngcgtctggattcaactttcgtgattatgccatgaactgggtccncaggctcgagggagggctggagtgggtagtttcattagagccatggcttagngctgggaacacgagaactaccggcccgngtcgtgtacgaaagggcaaggtacttcgattccaattccctaagaaaggagtactaggtaaaccttaccccgaaaggggctaacgtcccgacccttaatccgtaggaccaaggaattacggaaaaccacgggtccctaagggaaaaccgaccgaaagggacggaacccaaccgttaacggccccgtttactaaacgtttacgtgggtttacgggtttaaggggttacgttttttaacggtaagttttttagggg

SEQ ID NO: 353460 - DNA, 767 bp, Homo sapiens
  misc_feature: GZ8MTXP02HD87M.4.33.C11.1.454.CMB.2.raw
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagctgggttttccttgttgcttaattttaaaaggtgtccaatgtgaggtgcagctggtggagtcgtgggggagcttggtccagccagggccgtccctgagactctcctgtacagcgtctggtacttctaacttttcgtagtatttatcgccagtcgaaccgttcggggtccccgccgagggtcctccggaaagggggaacggggcttaggggaggttggggttagtttcaagttaggagcctaagttggctttagcgacgtagggaaccaaacgaggaaactaccggcccggtcgttacgtagggtaacgaaaacggggccaaaggtactttaccaaattaccctaagttccctaacgaaaaggtacgaattacggtaaccttaacccgaaaaccgggtccttaacgtccccgtaacccctttatttccgtacggaaccgtaaagggtacttaaacggaaaccgaccgggtacccgtaaacgggaaaaccggaaacccggaacggaaccacccgacgggtacccgttacttaagtttaaccgttcgggttaaggtttaaaggggttcgtttttaacgtaggtttttacgggagtttaggtaaactttaacgtttaaaccccg

SEQ ID NO: 353461 - DNA, 592 bp, Homo sapiens
  misc_feature: GZ8MTXP02JG98Z.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgaagaactacttagcttggtatcagcaagaaaccaggacagcctactaagctgctcagtttaccggcacgcctacccccggggaacgtcccggggtccctggacgcgtattccgaggtcggccgaggccggggtcgtcggggacagtatttccacgtctacaccatcagcacgcctgacgaggctagaacgtagtggtgtacgtagtttacgttacgtcgttacgaagtactaaattactttacctaacttaccgttaccgttaccggtaccgtttacgggaccgggtacgggaaccgtaagggtacgggacgaacgttacgaaaaccggtacgttacgg

SEQ ID NO: 353462 - DNA, 686 bp, Homo sapiens
  misc_feature: GZ8MTXP02JQ99B.4.33.C11.1.454.CMB.2.raw
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (549)..(549): a, c, t, g, unknown or other
  misc_feature (549)..(549): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggcgggccacatcaactgacaagtccagccagagtgttanatacagctaccaaanatgaagaactatagcttaggtactcagacaacgaaaccgtaggaccacgtcccctaactaacggccttagccttacgtacgttacccggggacacggtacccgtacccccggggtaacgtccccggggtaccctaggacgtccgtagttcgacgggttcggaccgtacggggccgggttacgacggggactaaggttactttccaccctctacccaacgtactaccgacgaccacggccctaggacgtaggacgtaggaagtagtcgggtcgtaacgtttaacgtttagttaccgngttacgaagtacctaaaatttccttacctaacccttaccgttccggttaaccggttccggtttaaccggggccgggaaacggtaacccggtaagggtacggtaaacgtaccgtaaacggtaaaaccgtacgttcggg

SEQ ID NO: 353463 - DNA, 547 bp, Homo sapiens
  misc_feature: GZ8MTXP02JRK0D.4.33.C11.1.454.CMB.2.raw
  modified_base (295)..(295): a, c, t, g, unknown or other
  misc_feature (295)..(295): n is a, c, g, or t
  modified_base (322)..(322): a, c, t, g, unknown or other
  misc_feature (322)..(322): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
  modified_base (431)..(431): a, c, t, g, unknown or other
  misc_feature (431)..(431): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttaattttaaaaggtgtccaatggtgaggtgcagctgggtggagtcgtgggggaggcttggtccagccgaggggccggtccctgagactctcctgtacagtcgtctggattcaacttttcgngtatttagcgccatgaactgggtcccncgaggctcgagggaggctggaggtggtagttcagttagagcagtggcttagngcgtaggacagagaataccgccgngtctgagaaagcagtatcatcatcagaagagangactcgaacgcagtcactatcngactaganagacncgacacggaacgacgaacgacacgtacgtacgttatacgttgtaggttaggttacggttagtttacgttagtttaggaacg

SEQ ID NO: 353464 - DNA, 699 bp, Homo sapiens
  misc_feature: GZ8MTXP02HVT4J.4.33.C11.1.454.CMB.2.raw
tcagagcactgtagcacgaccggtgctcgatttagagtgagctcgttggggttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaagtccagccagagtgttatatacagcctaccaaacaatgaagaaactacttagcttggtatcagacaagaaaacccaggaacacgccctacctaagctgctctacgtttaccggggcacggaccgtaaccccccggggaacgtccccggggtccctaggacggcgtaactttccgaaggtcggccaggggtccggggtcgtaggggacctaggtactttcaccttctacccaacctaatccaacgccacggtccctagaccgagggactaggaaagtagtgggtacggtacgttaaggttttaacttaccgtaggttaccaaacggtaccttaaaattactttaccttaacccgttaaacccgttcccggttaccgggttaacccggtttaccggggaccggggtaacggggtaaacccggtaaagggggttaacgggaacggtaacgtaaaccgtaaaaccggtaaccgtttacgggg

SEQ ID NO: 353465 - DNA, 593 bp, Homo sapiens
  misc_feature: GZ8MTXP02H7UOR.4.33.C11.1.454.CMB.2.raw
  modified_base (254)..(254): a, c, t, g, unknown or other
  misc_feature (254)..(254): n is a, c, g, or t
  modified_base (364)..(364): a, c, t, g, unknown or other
  misc_feature (364)..(364): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtctccagactcctggctgtgtctcgtgggcgagacgggccaccatcaactgacaagtccagccagagttgttatatacagctaccaanaatgaagaactacttagcttaggtatcagacaagaaaccaggacacgccctactaagctgctcacgttaccgggcacggccgtaacccccggggacgtccccggggtccnggacgcgtattcgagtggccgagcgggtctaggggacagtacttcactctaccacatcagcacgtcctgacgacggtctaggaagtgtggtgtacgttagtttattacgtgttacagtactaacttacttccttaaccttacttccgttacgggttaccgtttccgggggacgggtaacggtaaccggaagggttaaggacgtaacgtaccgaaaacggtaaccgtggg

SEQ ID NO: 353466 - DNA, 710 bp, Homo sapiens
  misc_feature: GZ8MTXP02J1H0U.4.33.C11.1.454.CMB.2.raw
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttcctgttgctatttaaaggtgtccaatgtgaggtgcagctggtggagtcgtgggggagcttggtccagccaggggccggtccctgagactctcctgtacagcgtctggattcaactttcgtgattatgccatgaacgtgggtccnccgaggctccgaggggagggctggagtgggtagttcattaganccagtggcttagngcgtggggaacacgagaaacgtaccgccggcgtcgtgtaaggaaagggtcaaggtacttcaaacttcattactacgaaaggagtatagaacttacccgaaaacgggctaacgtcccgaccgttaatcgttcggaacctaaggaacgttacgggaaaaccagggtacccccgttaaaggggaaaaccgggaacccgggaaaacggggaaacccaaaccggtaaccggtaccccgggtttaaacccttaaggttttaacccggttacgggggttttaaggggtttaaaccgggggttttaaaggttttttaaccggtttaaagggtttttttacgggggttaaaacgggg

SEQ ID NO: 353467 - DNA, 503 bp, Homo sapiens
  misc_feature: GZ8MTXP02JUUF2.4.33.C11.1.454.CMB.2.raw
  modified_base (233)..(233): a, c, t, g, unknown or other
  misc_feature (233)..(233): n is a, c, g, or t
  modified_base (313)..(313): a, c, t, g, unknown or other
  misc_feature (313)..(313): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
tcagagcactgtagcacgaccggtgctcgatttagagtgagctcgttgggttggggagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgttanatacagctcaacaatgagaactacttagcttggtatcagcagaaaccaggacagcctcctaagctgctcatttaccgggnagctacccccgggaatccggggtccctgagcgattcagtggcagcgggtctgggacagatttcactctcaccatcagcagccncgcngngagagagtgtgcgtagttattatgtgagacaatactactactactcgtacgtacgtacgtcggacggaacgaacggtacggacgacgacgaacgaacgtag

SEQ ID NO: 353468 - DNA, 642 bp, Homo sapiens
  misc_feature: GZ8MTXP02G15QW.4.33.C11.1.454.CMB.2.raw
  modified_base (181)..(181): a, c, t, g, unknown or other
  misc_feature (181)..(181): n is a, c, g, or t
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttcctgtgctatttaaaggntccaatgtgaggtgcagctggtggagtcgtgggggagcttggtccaggccaggggccggtccctgagacctctcctgtacngcgtctggattcaactttcgngattangccatgaactgggtcccncgaggcctcgaggggagggctggagtgggtagtttcagttaganccagtggcttagngcgtgggaacacgagaactcgccgcgtctggagaaagcagtattcatcatctacgaaagagtatagtaacttacccgaaacggctaacgtccgtacctacttcgtacggacaaggtaacttacggaaaccgtacggtaccccgttaaggaaaaccgggaacccggaacggaaccgaaccgtaaccggtacccggttacttaacgtttaaccgttagggtttaacggtttaacgggggtttaacgtttttaaccggttaggttttttaggggtaaacgg

SEQ ID NO: 353469 - DNA, 748 bp, Homo sapiens
  misc_feature: GZ8MTXP02IHRV1.4.33.C11.1.454.CMB.2.raw
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagcgtgggtggagtcgtgggggaggtcgttggtccagccgaggggccggtccctgagtctctcctgtacngcgtctggtattctaactttcgngatttatcgaccagtcgaaccgtggggtccccgccgtagggcctaccggaagggggtacggggcgtggggtaagggtttcgggggttaaggtttacgaagtttacggaaacgtccgtagtgggtacctttagcggtacgtaggggaacaacgagtaaacgtacccggccgtacgttctagggtaacgaaaagggtcaagtacttacaattctaattcctaagaaaggtagtaatcgtaaaccgtttacccgaaacggtcctaacgttcccgacttactccgtacgacgaaggtaactacggaaacgtacggaaccgtaacgggaaaacgacccgggaaacgggtaaccaaccgtaccgggtaaccctttaagtttaacgttaaccggtttaggttaacggggtttttaacgggggttaagtttttaacggtttaggtttttacggggtaaacgg

SEQ ID NO: 353470 - DNA, 706 bp, Homo sapiens
  misc_feature: GZ8MTXP02GQSXT.4.33.C11.1.454.CMB.2.raw
  modified_base (266)..(266): a, c, t, g, unknown or other
  misc_feature (266)..(266): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttggcttagctgggttttcctgttgcttatttaaaggtgtccaatgtgaggtgcagcgtggtggagtcgtgggggagtcgttggtccaggccgagggccggtccctgagacctctcctgtacngtcgtctggtattactaacgtttcgagtatttatcgacctagtacgaaccgttcggggtccccgccgacgggcctacccgggaaagggggaacggggtcttggggtaagggtttggggttacggttttacaaagtttacggacgtcctaagttcgggtacttttagcgggtacgtaggggaacctaacgacgaaacgtaccggcccgtacgtacgtaggtaacggaaacgctaaggtacttacgaatctaatcctagaaagatacgtagaacttaccgaacggtctactccgtaccttacgtccgtagtacgaagtacgtacgaaccgtacgaccgtacggaaacgacgaacggtaccaacgtacgtacccgttaacgttacgttaacggttggttagggtttacgggttacgttttaacggttacgttttagggtaacg

SEQ ID NO: 353471 - DNA, 604 bp, Homo sapiens
  misc_feature: GZ8MTXP02I42AW.4.33.C11.1.454.CMB.2.raw
  modified_base (311)..(311): a, c, t, g, unknown or other
  misc_feature (311)..(311): n is a, c, g, or t
  modified_base (428)..(428): a, c, t, g, unknown or other
  misc_feature (428)..(428): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttcctgttgctattttaaaggtgtcaatgtgaggtgcagctgggtggagtcgtgggggaggtcttggtccagccgaggggccggtccctgagactctcctgtacagcgtctggattcaactttcgtgtattatgccatgaacgtgggtccnccgaggcctaccgaggggaggggctgggaggtgggtagtttcagttagagcatggcttagtgcgtgggacagagaataccgccgcgtcgtgtagaaagcgagtatcatcatacctanaagagatgtaacttacccgaaacggctaacgtccgaccttactccgtgacgtaagacgtacgaaacgacgtacccgaaggaaaacgaccggaacggaaacgaacgaccgggaccttacgttaacgttaacgtagttaggttagggttacgtttaacgtttaggttttaggtaaggg

SEQ ID NO: 353472 - DNA, 523 bp, Homo sapiens
  misc_feature: GZ8MTXP02GP7FQ.4.33.C11.1.454.CMB.2.raw
  modified_base (309)..(309): a, c, t, g, unknown or other
  misc_feature (309)..(309): n is a, c, g, or t
  modified_base (361)..(361): a, c, t, g, unknown or other
  misc_feature (361)..(361): n is a, c, g, or t
  modified_base (456)..(456): a, c, t, g, unknown or other
  misc_feature (456)..(456): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccaggggcggtccctgagactctcctgtacagcgtctggattcaactttcgtgattatgccatgaactgggtccncaggctccaggggagggctggagtgggtagtttcattagagccatggcttangctgggacacgagaatacgcgcgtctgtagaaagcagattcatcatctacaagagatgattaccgaacggcatcgacctatctgacagatgaacngcctagaacgaccgaggacacgacgccgtatatcgtagtggttaggtagtttacgtagttttggtag

SEQ ID NO: 353473 - DNA, 591 bp, Homo sapiens
  misc_feature: GZ8MTXP02HVFBD.4.33.C11.1.454.CMB.2.raw
  modified_base (241)..(241): a, c, t, g, unknown or other
  misc_feature (241)..(241): n is a, c, g, or t
  modified_base (394)..(394): a, c, t, g, unknown or other
  misc_feature (394)..(394): n is a, c, g, or t
tcagagcactgtagcacgaccggtgctcgatttagagtgagctcgttggggttggggggagctacaacaggcaggcaggggcagcaagatggtgttgcagacccaggtcttcatttctctgttgctctggatctctggtgccgtacggggacatcgtgatgacccagtctccagacctccctggctgtgtctcgtggggcgaggagggccacatcaactgcaagtccagccagagtgttanatacagctaccaacaatgagaactacttagcttggtatcagcaagaaaccaggacagcctactaagctgctacagtttaccgggcacggacgtacccccggggaagttccccggggtcctaggacgcgattcgaggtggcacgggcgggtcgngggacagtattcgactctcaccatcacgcacgcctgacgacggctaggaagtagtgggtaggtacgtaagtttaattacgtggtactacgtactaaattacttacttacctaaccttccgttaccggttacgtttaccgggaccgggacggtaaccgaagggtacggacgtaactaaccgaaaacggtacgtacggg

SEQ ID NO: 353474 - DNA, 561 bp, Homo sapiens
  misc_feature: GZ8MTXP02JSAS9.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagtgttatatacagctaccaaacaatgaagtaaactacttaagcttggtatcagcaagaaaccaggacagcctacctaaagctgctctaacgtttaccggggcacggcctaaccccccggggaatccccgggggtccctaggacgcgtattcgagtggcaggcgggtctagggacagtatttcactcgtacaccatcacgcacgcctgacgaggctagaaagatggtaggacttagtttattacgtgtacagtactaattacttactactactccgtcggtacttcggacggaggaaccgaaggtaggacgaacgtacgaaaacgacgtgg

SEQ ID NO: 353475 - DNA, 630 bp, Homo sapiens
  misc_feature: GZ8MTXP02JC4JK.4.33.C11.1.454.CMB.2.raw
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
  modified_base (390)..(390): a, c, t, g, unknown or other
  misc_feature (390)..(390): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggagcttggtccagccgaggggcgtccctgagactctcctgtacagcgtctggattcaactttgnattatgccatgaactgggtcccncgaggctcgaggggaggctggagtgggtagttcagttagacgcagtggcttagtgctgggaacacgagaaactaccgccgngtctgtagaaagcaagtacttcatcatctacgaaagagtatgtaacttcccgaaacggctaacgtccgtccttaagtccgttagaccgtaagtaacgttacgaaaacgacgacccgtaaaggaaaacgggaacccgaacgggaaacccaacgacgtacccgttacttaaaccgtttaacgtaggtttaacgggtttacggggttaagtttttaccggttaaggttttttagggtaaaggg

SEQ ID NO: 353476 - DNA, 608 bp, Homo sapiens
  misc_feature: GZ8MTXP02JXEXS.4.33.C11.1.454.CMB.2.raw
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggcccaccatcaactgcaagtccagccagagtgttatatacagctccaacaatgaagaactacttagctggtancagcagaaaccaggacagccnctaanctgctntactttccggggcagctaacccccgggatcccggggtcctgagcgattcgagtggcgagcgggtctggggacagatttcactctcaaccctatcagacgagccccgtagcagggtacttgaaagtagtgggtggacgttaagttttactttactacggttcaacggtacctaaaatttacttttactttaaaccgtttaaccttccccgttaccgggttaacccgttttccggggacgggaacggggtaaccgaagggttaggaacggtacttaaaccgaaaaccgtaaaccgtttacgggg

SEQ ID NO: 353477 - DNA, 559 bp, Homo sapiens
  misc_feature: GZ8MTXP02H7MQY.4.33.C11.1.454.CMB.2.raw
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaggtgtccaatgtgaggtgcagctggtggagtcgtggggggagcttggtccaggccaggggcggtccctggagactctcctgtacagcgtctggattcaacttttcgngatttangccatgaactgggcccncaggctccgaaggggagggctggagtgggtagttcattagagcagtggctttangcgtgggaacaacgagaaactaccgccgtcgtcgtgtagaaagcagattcancattcanaagagatagattaccaaacggcaactcgactatcgtagcagatagaacagaccgagaacgacgaacggacaacgacgtacccgtatacttaacgtgttaggttaggtagtttttacggtagtttttaggaagg

SEQ ID NO: 353478 - DNA, 576 bp, Homo sapiens
  misc_feature: GZ8MTXP02JU16E.4.33.C11.1.454.CMB.2.raw
  modified_base (303)..(303): a, c, t, g, unknown or other
  misc_feature (303)..(303): n is a, c, g, or t
  modified_base (355)..(355): a, c, t, g, unknown or other
  misc_feature (355)..(355): n is a, c, g, or t
  modified_base (467)..(467): a, c, t, g, unknown or other
  misc_feature (467)..(467): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccaggggcgtccctgagactctcctgtacagcgtctggattcaactttcgtgattatgccatgaactgggtcccncaggctccgaggggagggctggagtgggtagttcattagagccatggcttangctgggacaacagaactacgccgcgtctggtagaaaggcaagtacttcatcatctacaaagagatgaacttacccgaacggcacgtcgaccctatctgcagatacggaaacncggacctagaaacgacccgaaagaccacgacgccgttactagttactagttaggttaggggtaagttttacgtagtttttagggagttacggtaattacgtttaaaccc

SEQ ID NO: 353479 - DNA, 569 bp, Homo sapiens
  misc_feature: GZ8MTXP02F5BHT.4.33.C11.1.454.CMB.2.raw
  modified_base (251)..(251): a, c, t, g, unknown or other
  misc_feature (251)..(251): n is a, c, g, or t
  modified_base (322)..(322): a, c, t, g, unknown or other
  misc_feature (322)..(322): n is a, c, g, or t
  modified_base (409)..(409): a, c, t, g, unknown or other
  misc_feature (409)..(409): n is a, c, g, or t
  modified_base (453)..(453): a, c, t, g, unknown or other
  misc_feature (453)..(453): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatccaactgcaagtccagccagatgttatatacagctccaaanaatgaagaaactacttagcttggtatcagacaagaaaccaggacagcctactaagctgctcattaccgggnacgcctaccccgggaatcccggggcctgacgcgattcgagtggacaggcgggtctagggacagctttcactctcacatcagcagccngcgaggtcaggaagtagtggtgtacgttagtttacttactgtanacgtactaacttacttacttaccttaccttaccgttacggttaccggttaccgggtacgggtaacgggaacggtaacgggtacggtaacgtaacgtaacgtaaacgtaacgtacgg

SEQ ID NO: 353480 - DNA, 600 bp, Homo sapiens
  misc_feature: GZ8MTXP02HFI8A.4.33.C11.1.454.CMB.2.raw
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaagtccagccagagtgttanatacagctaccaaanaatgaagaactacttagcttggatcagcaagaaaccaggacagcctactaaagctgctcattaccgggcagcctaaccccgggatcccggggtcctagagcgattcagtggaccaggccgggtctagggacagactttcacttcacaccataccagccaacgcctcgacgaggactaaggaaagtagtacgggtacggtacgtttaagtttaacttacgtagtactaagtaactaaattacttaccttaaccgttaccgttccgttaccggttaccgtttaccggggaacgggtaacgggaacgtaaagggtacggaaacgtaacgtaaacgaaaacgtaacgtgg

SEQ ID NO: 353481 - DNA, 602 bp, Homo sapiens
  misc_feature: GZ8MTXP02GTLKM.4.33.C11.1.454.CMB.2.raw
  modified_base (252)..(252): a, c, t, g, unknown or other
  misc_feature (252)..(252): n is a, c, g, or t
  modified_base (459)..(459): a, c, t, g, unknown or other
  misc_feature (459)..(459): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagtgttatatacagctaccaanaatgaagaactacttagcttggtatcagacaagaaaccaggacacgccctactaagctgctctacgtttaccgggcacggaccgtaaccccccggggaacgtcccggggtccctggacgtccgattccgaggtcggcagggtcgggtactaggggactagtatttcactctacacgatccagacacgcctgaccgagacgtagaagngtagggtacgtacgttaagtttattacgtgtacaagactaacttacttacttacctactaccgttcggtaccgtttccggggacggtaacgggaaccgtaaagggtacggtaacgtaacgtaaccgtaaaacggtacgttagg

SEQ ID NO: 353482 - DNA, 712 bp, Homo sapiens
  misc_feature: GZ8MTXP02F5P3R.4.33.C11.1.454.CMB.2.raw
  modified_base (269)..(269): a, c, t, g, unknown or other
  misc_feature (269)..(269): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggagcttggtccagccgagggccggtccctggactctcctctagtacgngtcgtgtgtactacttacgttcgtatattgcactgtacgtacggtcggcccgcgcggtccgtacggggaaggggacggtcggtaggggtagggttaggggtttagtttactagttacgacgtacctaggtcggttacttagcggtggtacggaaacaacgaacgtaaacgtaccggccgtcgttcgtaggtaaacggaaacgctaagttactactactactactcctaaagaaagtagtatacgtaaaccgttacccggaaacggtacctacgtcccgttaacttacgtccgtagactaaggtacgaacgaaacgaccgtacgaaaacggaaacggacccggaacgaacccgacggtaccgtacccttagtttaaccttaaggttgggttttaacgggttaaacggtttttagttttacggttttaaggtttcggggttaaag

SEQ ID NO: 353483 - DNA, 613 bp, Homo sapiens
  misc_feature: GZ8MTXP02HS7TW.4.33.C11.1.454.CMB.2.raw
  modified_base (296)..(296): a, c, t, g, unknown or other
  misc_feature (296)..(296): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (450)..(450): a, c, t, g, unknown or other
  misc_feature (450)..(450): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttattttaaaggtgtccaatgtgaggtgcagcgtggtggagtcgtgggggaggtcttggtccaggccgaggggccggtccctggacgtactctcctgtacagcgtctggattcaacttttcgngtacttatgccatcgaacgtgggtcccgccgaggcctccgaggggaacgggctgggagtgggttagttcagttagagccagtggacttagcgcgtagggacacgagaactacgccgngttcngtagaaagcagtatcgatcactctacgaaganatagtacttacccaacggctaacgtccgtacctatctagacagacgtacgaaactacgacccgtaaggaaacgaacccgggaacgaaccgaaccacgtacccgttacttagttaacgttggttaggtttacggttagtttttaccggtagtttttacggaagg

SEQ ID NO: 353484 - DNA, 504 bp, Homo sapiens
  misc_feature: GZ8MTXP02FLG3P.4.33.C11.1.454.CMB.2.raw
  modified_base (236)..(236): a, c, t, g, unknown or other
  misc_feature (236)..(236): n is a, c, g, or t
  modified_base (318)..(318): a, c, t, g, unknown or other
  misc_feature (318)..(318): n is a, c, g, or t
  modified_base (379)..(379): a, c, t, g, unknown or other
  misc_feature (379)..(379): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttanatacagctaccaacaatgagaactacttagcttggtatcagcaagaaaccaggacagcctactaagctgctcatttaccggnacgcctaacccccgggatccggggtcctgacgcgattcagtggcagcggtctgggacagtntttcactctcaccatcagcagcctgacaggctgaagatgtgactagtttatactgtcagacaatatctactactccgtcgtacgttcggcggtacggaacgaggtcgagactacaaacgactagg

SEQ ID NO: 353485 - DNA, 868 bp, Homo sapiens
  misc_feature: GZ8MTXP02JDFPF.4.33.C11.1.454.CMB.2.raw
  modified_base (169)..(169): a, c, t, g, unknown or other
  misc_feature (169)..(169): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagttggcttagctggtttctgtgctatttaaagngtcaatgtgaggtgcagctggtggagtcgtgggggagcttggtccagccgagggccgtccctgagactctcctgtacagtcgtctggattcaactttcgtgattatcgcctagtgaacgttcggggtccccgaccgagggcctccggaggggggtaaacggggtcgtggggtaaggttgggggtttaaggttttaccgaagtttacggaacggtccctaagttcggggtactttaagtccggtacgttacggggaaaccaaaaccgaaggtaaaacgttacccgggcccggtcggtttacgttaggggttaacggaaaaaacgggggtcctaaaagggtacgtttaccgtaaacttaccgtaacgttaccctaaacgtaaaaaggtaacggtaaagtttacgggtaaaccttttaaaccccgggaaaccggggtacccttaaaaccgttccccgggtaccgttaaacttccgttacggtaccgaaagggtaacttaacgggaaacccgaacggttaacccgtaaggaaaaccgggaaccggaacggggtaaacccaacgtaaccgggtacccgtttaacgttaaacgtttaccggttaaggggtttacggtttaaacgggggtttaagtttttaccggtttaaggttttttacgggaacgggtttagggttaaacgttttaaacgttttaaaacccccg

SEQ ID NO: 353486 - DNA, 691 bp, Homo sapiens
  misc_feature: GZ8MTXP02F7DCX.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctcctggctgtgtctcgtgggcgagacgggccacatacaactgacaagtccagccagtagtgttaatatacacgctaccaaacaatgaacgaactactagtcttaggtatacagacaaagaaaccaggacacgccctacgtaagctcgctactacgtttaccgggacacggtacccgtaacccccgggaacgttccccggggtccctaggacgaccgtaattccggaaggtcggaccgaggggtcccggggtacgtagggggaacctaacgttacgtttaccctacctcctaccaaccctatccgacgaccacgcccgtgaccgagcgtaggaagtgtagggtgacgttaagttttaacgttacgtggtacctagtacctaaattactttaccttaccgttaacccttaccggttaccggttaaccggttttaccgggggaccgggtaacgggtaacccggtaaaggggtacggtaaaacggtacgttaaaccgtaaaaccggtaacgtttacgggg

SEQ ID NO: 353487 - DNA, 586 bp, Homo sapiens
  misc_feature: GZ8MTXP02FVS8Q.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaaccaaccatggagtttgggcttagctgggttttccttgttgctattttaaaaggtgtccaatgtgaggtgcagctggtggagtcgtgggggagcttggtccagccagggcggtccctgagactctcctgtacagcgtctggattcaactttcgtgattatgccatgaactgggtccgccaggctccgaggggaggggctgggagtgggtaggtttcagttagagccagtggcttatgctggggaacacgagaaactacgcccgcgtctgtagaaaggcagattcatcatctacaaagagatgtacttacccgaaacgggcactcgacccttatcctgcagatagaaacacgcctagaaacggaaccggacggaaccaacgacggtacccgtacttaacgttaacgttaggttacggtttaggggttaagtttttacggtagtttttagggtaagg

SEQ ID NO: 353488 - DNA, 574 bp, Homo sapiens
  misc_feature: GZ8MTXP02F7OEK.4.33.C11.1.454.CMB.2.raw
  modified_base (308)..(308): a, c, t, g, unknown or other
  misc_feature (308)..(308): n is a, c, g, or t
  modified_base (359)..(359): a, c, t, g, unknown or other
  misc_feature (359)..(359): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccagggcggtccctgagactctcctgtacagcgtctggattcaactttcgtgattatgccatgaactgggtccncaggctcgagggaggctggagtgggtagtttcattagagccatggcttagngcgtgggaacacgagaaactaccgccgcgtctggtagaaagcagattcatcatctacaagagatgacttaccgaacggcactcgacccttagtcctgacagaatacgaaacacgccgtagaaacggaccgaacggaaccacgacgacccgttacttaacgttaacgttggttaggtttacggggttagtttttacggttagtttttgggtaaagg

SEQ ID NO: 353489 - DNA, 580 bp, Homo sapiens
  misc_feature: GZ8MTXP02F85PP.4.33.C11.1.454.CMB.2.raw
  modified_base (381)..(381): a, c, t, g, unknown or other
  misc_feature (381)..(381): n is a, c, g, or t
tcagagcactgtagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatacgccttctcccgtccccccttcgcagtaacaccaagtacagaatattaacctgttcccatcgactacgcctttcggcctcgccgttagggtcactcaccctgccccgattaacgtgacaggaacccttggtctccggcgagcgggtctttcacccgtntttactccgttacttatgtaccagcattcgcacttctgactacctcagcatcgcctcacagcacaccttacacacggacttaacacgaaaccgcctacccctacccaaacgaaccgaccataaacgcgtcgctcgccgcacgtccttgtcgcagttcgttacgccccgtttcaacgtccttcccgccatctcgactacg

SEQ ID NO: 353490 - DNA, 635 bp, Homo sapiens
  misc_feature: GZ8MTXP02JVITX.4.33.C11.1.454.CMB.2.raw
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtcctccagacctccctggctgtgtctcgtgggcgagacggccaccatcaactgacaagtccagccagagtgttatatacagctaccaanaatgaagaactacttagcttaggatcanacaacgaaaccaggacagaccctacgtaagtctgtacctactaacgtttacccggggacacggacccggtaaccccccggggacgtccccggggtaccctaggacggcgtattcgacgggttcggacgtacggggcgggttcggtagggaaccgtagtacgtttaccaccgttacctacccaacctacgtaccgacgtaccgacggtcctacggaccgacggtacgtacgaagtgttacgggtaggtacttagtttactacgtgtacagtactaattacttacctactaccttcctcggtacgttccggaggtacggaacgtagggtacgacgactacgtaacgaacgtcgg

SEQ ID NO: 353491 - DNA, 586 bp, Homo sapiens
  misc_feature: GZ8MTXP02IF7CD.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacggccaccatcaactgcaagtccagccagagtgtatatacagctacaacaatgaagaactacttagcttaggtatacagacaagaaaccaaggacacgtaccctactaaagctcgctactacgtttaccgggcaacgccgtaacccccgggaacgtcccggggtcctggacgccgtattcgagtcggacgacggtccggggtacgtaggggaactagtactttaccactactacaccatcaacgcacgctgacgtacggctagacgtagtggtacggtattagttactactcgtacaatactaattacttactacctacgtccgtacgtaccgttacggaccggtaggaaccgtaacggaggtacaacgtaacgaaaacgacgtcgg

SEQ ID NO: 353492 - DNA, 721 bp, Homo sapiens
  misc_feature: GZ8MTXP02J1QKO.4.33.C11.1.454.CMB.2.raw
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (459)..(459): a, c, t, g, unknown or other
  misc_feature (459)..(459): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagctggtggagtcgtgggggaggcttggtccagccgagggcggtccctgagactctcctgtacngcgtctggattcaactttcgtgattangccatgaacgtgggtcccnccgaggcctccgaggggaaggggctgggaggtggggtaggtttcagttaggacgcctagtcgggtcttagtcggccgtaggggaacaacgagaaactaccgcccgtcgtcgtaggtacggaaaaggcaagactttacattccatcctanaaagagtatacggtaacttacccgaaacgggcctaacgtccggtaccccttaatcccgttaggaccaaagggtacttacggaaaaccgacggtaacccgtacggaaaacgggaacccgggaaacggggaaaccctaaaccggaccggtacccggtttaacctttaaacggtttaaccggtttacggggttaacggggtttttaaacgggggtttaaaggttttttaaccgggtttaaggttttttaacggggtttaaagggg

SEQ ID NO: 353493 - DNA, 785 bp, Homo sapiens
  misc_feature: GZ8MTXP02F9W2F.4.33.C11.1.454.CMB.2.raw
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
tcagagcactgtagcacgaccggtgctcgatttagagtgagctcgttgggtttgggggggagaggagccccagccgtgagattcccaggagtttccacttggtgatcagcactgaacacagacccaccaaccatggagtttgggcttagcttgggttttccttgttgcttaattttaaaaggtgtccaatgtgaggtgcagctggtggagtcgtgggggagtcttggtccaggccgaggggccggtccctgacgactctcctgtacngccgcctggattcaacttttcgngtattatcgacctagtacggaaccgttcggggtccccgaccgaacgggccccgttaccccggaaaggggggggaaacgggggtccgttagggggtaacggggtttgggggtttaaacgggtttttaccaaagttttacggaacgtaccccgtaagttcggggtacttttaaggtccggtaccggttaggggaaaccaaacgtaagaaaacgttcccggcccggtcgttacgtaggtaaacgaaaaggcaaagttacttacacttacatacctacgaaagtagattcgaacttaccgaaacgggcctaacgttccccgacttaacgttcgtacggtaccaagtaactacggaaaccacggtacccgaagggaaacgacccggaacggacctaaccgaccggtaccttaacttagttacgttacggttaggtttaacgggttaaagttttacgtttagtttttacgggagttacggtaaacttactttaaaaccccg

SEQ ID NO: 353494 - DNA, 743 bp, Homo sapiens
  misc_feature: GZ8MTXP02ILYOP.4.33.C11.1.454.CMB.2.raw
tcagagcactgtagcacgaccggtgctcgatttagagtgagctcgttggggtttgggggagctacaacaggcaggcaggggcagcaagatggtgttgcagacccaggtcttcatttctctgttgctctggatctctggtgccgtacggggacatcgtgatcgaccagtctccagactccctggctgtgtctcgtgggcgagacgggccaccatcaactgacaagtccagccagagttgttaatatacagcctaccaaacaatgaagaaactacttagcttaggtatcagacaagaaaccgaaggacaacgccctactaaagcctgtctactacgtttacccgggactaacggcccgttaaccccggggaaccgtccccggggtaccctaggacgtaccggtaactttccggacggttcggggaccgtaacgggtcccgggggttcgtagggggaaccgtaagttacgttaccctactacctaccaaaccctacgttaccgaacgtaccgacgtaccgtcgaaccgtaggaccgtaggtaaaagtggttacgggttacggtccgttaaggtttttaacgttaacgttacggtactaacgtacttaaactttactttacttaaaccggttaccgtttacccgttaacgggttacccgtttaccgggggaaccggggtaacggggtaaaccggtaaacggggtagggtaaacgtaagtaaccccgaaaaggttaccgttaacgggg

SEQ ID NO: 353495 - DNA, 544 bp, Homo sapiens
  misc_feature: GZ8MTXP02F7BXD.4.33.C11.1.454.CMB.2.raw
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggagcttggtccagccagggcgtccctgagactctcctgtacagcgtctggattcaactttcgtgattatgccatgaactgggtccgccaggctccgaggggaagggctgggagtgggtaggtttcagttagagcagtggcttangctgggaacacagaatacgccgcgtctgtagaaaggcagnttacatcatctcaaagagatgattacccgaacggcatcgacctatcctgacagatgaacagcctaggaagaccgaaggaccacgacgccgtactacttaacgtgttaggttagggtatttttacggtagtttttgggtaag

SEQ ID NO: 353496 - DNA, 595 bp, Homo sapiens
  misc_feature: GZ8MTXP02JO7OF.4.33.C11.1.454.CMB.2.raw
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
  modified_base (364)..(364): a, c, t, g, unknown or other
  misc_feature (364)..(364): n is a, c, g, or t
  modified_base (423)..(423): a, c, t, g, unknown or other
  misc_feature (423)..(423): n is a, c, g, or t
  modified_base (568)..(568): a, c, t, g, unknown or other
  misc_feature (568)..(568): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggcttggtccagccgagggcggtccctgagactctcctgtacagcgtctggattcaactttcgngatttatgccatgaactgggtccncaggctccgagggagggctggagtgggtagtttcagttagagcagtggcttangctaggacacagaactaccgccgcgtctgtagaaagcaagattcatcatctacaagganatgacttcccgaaaggctactaccggtccttaattccgcggactaaggactacgaacacgacccttaggaaaccggaccggaacggaacaacccggacgtacccgttactaagtttaaccgtaggttaggtttaaacgggggttntttttaacggttagtttttaggtaagg

SEQ ID NO: 353497 - DNA, 609 bp, Homo sapiens
  misc_feature: GZ8MTXP02JTJVQ.4.33.C11.1.454.CMB.2.raw
  modified_base (401)..(401): a, c, t, g, unknown or other
  misc_feature (401)..(401): n is a, c, g, or t
  modified_base (441)..(441): a, c, t, g, unknown or other
  misc_feature (441)..(441): n is a, c, g, or t
  modified_base (477)..(477): a, c, t, g, unknown or other
  misc_feature (477)..(477): n is a, c, g, or t
  modified_base (520)..(520): a, c, t, g, unknown or other
  misc_feature (520)..(520): n is a, c, g, or t
  modified_base (571)..(571): a, c, t, g, unknown or other
  misc_feature (571)..(571): n is a, c, g, or t
tcagagcactgtagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccggccaacatacgccttctccgtcccccttcgcagtaacaccaagtacaggaatattaacctgttcccatcgactacgccttcggcctcgccttagggcactcacctgccccgtattacgttggacaggaacccttggcttccggcgagcggtctttcgaccgtctttatcccgttacttatgtacngctattcgctaacttctgactacccgctagcatgaccctnacagcacaccttcaacgacgtacttacgacgaaccncccctacccctaaacccaaactaaacgcctaaagtacgcgtcncgtcgccgacacgtcgttacggcgcctacgttcggtttaccgcccctttanaacgttcccgttacccgctactccgtacgtaacctacg

SEQ ID NO: 353498 - DNA, 504 bp, Homo sapiens
  misc_feature: GZ8MTXP02FFS3T.4.33.C11.1.454.CMB.2.raw
  modified_base (237)..(237): a, c, t, g, unknown or other
  misc_feature (237)..(237): n is a, c, g, or t
  modified_base (316)..(316): a, c, t, g, unknown or other
  misc_feature (316)..(316): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttaanatacagctccaacaatgagaactactagcttggtatcagcaagaaaccaggacagcctctaagctgctcatttaccggnagctacccccgggaatcccggggcctgagcgattcagtggcagcggtctgggacagatttcactctcaccatcagcagcctgcaggctgaagatgtgctagtttattactgtcagtcaaatacttctactactcctcggactttcgggcgagggaaccgaaggttcggagactacgaaaacgactagg

SEQ ID NO: 353499 - DNA, 667 bp, Homo sapiens
  misc_feature: GZ8MTXP02GFA6Z.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggtccaccatacaactgacaagtccagccagtagtgtatatacagctaccaaacaatgaagtaaactacttagtcttaggatacgagacaacgaaaccaggacacgccctactaagctcgtcctacgtacgttaccgggctacggtacccgtaccccgggaacgtcccggggtccaggacgacgtatccgaggtcggcgagggtcgggtcgtagggactagtactttaccgacttccgtaccaacgtactccgacgcgacgtcctggaccgaggtacgtaggtaaacgtgtagggttacgtacttaaggtttacttacgtagtacaagtaactaagtttacttaccttaccgttacccgttaccgggtaccggttaacggtttacccggggaacgggtaacggggtaaccggtaaggggtacggtaaacgtaaccgtaaacggaaaaccggttcggttaccggg

SEQ ID NO: 353500 - DNA, 583 bp, Homo sapiens
  misc_feature: GZ8MTXP02IGU5R.4.33.C11.1.454.CMB.2.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttcctgtgctattttaaaggtgtccaatgtgaggtncagctggtggagtcgtgggggagtctggtccagccgagggcgtccctgagactctcctgtacagcgtctggattcaactttcgngatttatcgcctatgaactgggtccncgaggctccgagggagggctggaggtgggtagttcagttagagccagtcggcttancgcgtagggacagacgaaatacccggccgtcgtcgtgtaggaaagcagtattcatcatctacgaagagatgacttaccgaacggctatccgtactactccgtgactaggatacgaaacgacgaccctaggaaacgaaccggaacgaaccaacgacgtaccgtactaactttaagtggtttacggttacgggttagtttttacggtagtttttaggtaagg

SEQ ID NO: 353501 - DNA, 808 bp, Homo sapiens
  misc_feature: GZ8MTXP02FY6OK.4.33.C11.1.454.CMB.2.raw
  modified_base (260)..(260): a, c, t, g, unknown or other
  misc_feature (260)..(260): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgtgctattttaaaaggtgtccaatgtgaggtgcagctggtggagtcgtgggggagcttggtccagccagggcgtccctgagactctcctgtacngcgtctgtatctacttcgtgtattatcgctatcgaacgtcgggtccgccgaggccgtacggaggggaacggggcgtaggggtagggttggggttaggtttacgtaagttaggacgtaccgtacgtggtacttagtcggcggtacgggaaacaacgaacggtaaacgtaccggcccggtacgttcgtagggtaagggaaaacggacgaagttaacttacgtaattacctacttaccgtaacgaaaggtaagtaagttacggtaaaccgttaacccggaaaccgggtacccgtaacgttaccccgtacccgttaacttaccgtacggtaaccgtaacggtaaacgttaacggaaaccgtaccggtaaacccggtaaacgggaaaaccgggaaacccggggaaaccgggtaaacccgaaaccgtaccgggttaacccgtttaaccgtttaaaccggtttaacggtttaacggggttttaacgggggttttaaacgggggttttaaacgggtttttaaacgggttttaacgggttttttacggggtaacggg

SEQ ID NO: 353502 - DNA, 534 bp, Homo sapiens
  misc_feature: GZ8MTXP02JLOLO.4.33.C11.1.454.CMB.2.raw
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaaacaatgaagaactacttagcttggtatcagcaagaaaccaggacagcctctaagctgctcagtttaccggcacgcgtacccccgggaatcccggggccctggacgcgattcgagtggcagcgggtctggggacagattcgactcgtcaccatcagcacgcctgacagggctaggaagtactgggtaggtactagtttacttacgtgtacagataatacttctactactcctacgtccgtttcggacggaggtaaccgaaggtacggagacgtacgaaaacgacgtag

SEQ ID NO: 353503 - DNA, 587 bp, Homo sapiens
  misc_feature: GZ8MTXP02G07VQ.4.33.C11.1.454.CMB.2.raw
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtggggcgagacgggccaccatcaactgacaagtccagccagagtgttanatacagctaccaanaatgaagaactacttagcttaggatcagacaagaaaccaggacagcctactaagctcgctacagtttaccggcacggaccgtaacccccggggaactcccggggtcctggacgcgattcgagtggcgagcgggtctggggacagtattcactctacaccatcagcacgcctgacaggactagaagtagtggtacggacttaaggtttacttacgtggttaccagtactaaattacttactaaccttaccgtccgttacggttaccgtttcggggacgggtaacgggtaaccgtaagggtaggaaacgaacgtaacgaaaacgtaacgttcggg

SEQ ID NO: 353504 - DNA, 570 bp, Homo sapiens
  misc_feature: GZ8MTXP02GYSG8.4.33.C11.1.454.CMB.2.raw
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
tcagagcactgtagcacgaccggtgctcgatttagagtgagctcgttggggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccgtcaactgcaagtccagccagagtgttatatacagctaccaaacaatgaagaactacttagcttaggtatcagacaagaaaccaggacacgcctactaagctgcctctacgtttaccgggctacgccgtaccggggaacgtcccggggtcctggacgcgtattcgaggtcggcgagggcgggtcgtggggacagtacttcgactctacacatacacgcacgtcncgacgaggctaggaagngtcgtaggtactagtttatactagtacagtactattattactacttactccgtacggtacgtttcgggaccggaggaaccggtaaggtacggaacgtacgacgtaaacgacgtaggtacgg

SEQ ID NO: 353505 - DNA, 736 bp, Homo sapiens
  misc_feature: GZ8MTXP02FSG8B.4.33.C11.1.454.CMB.2.raw
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (600)..(600): a, c, t, g, unknown or other
  misc_feature (600)..(600): n is a, c, g, or t
tcagagcactgtagcacgaccggtgctcgatttagagtgagctcgttggggtttgggggggagaggagccccagccgtgagattcccaggagtttccacttggtgatcagcactgaacacagacccaccaaccatggagtttgggcttagcttgggttttccttgttgcttaattttaaaaggtgtccaatgtgaggtgcagcgtgggtggaggtcggtgggggagtcgttggtccaggccgaggggccggtccctgacgactctcctgtacngcgtntggtattactaactttcgngtattatcgacctagtacggtaacggtcggggtccccgaccgacggtccgtaccgggaaggggggaacggggtcgtaggggtaggttaggggtttacggtttacgtaagtttacggacgtacctaggtcggtacttagccggtacgtagggaaacaaacgaggaaaccgtcccgggccggtcgttacgtagggtaaggaaacggtctaaagttacttacacttactaacttaccgtaaacgaaagtagtaacgttacgtaacccgttaccgaaacggctaccgtccgtaccttatcgtacganaagtactacgacacgtaccgaaggaaccgacggaacgacacggtactaccgttattacgttacgttaggttagggtttaacggttaagttttaggttagttttagggagtttagtaactttaacgtttaaaccccg

SEQ ID NO: 353506 - DNA, 584 bp, Homo sapiens
  misc_feature: GZ8MTXP02G7WQI.4.33.C11.1.454.CMB.2.raw
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
  modified_base (467)..(467): a, c, t, g, unknown or other
  misc_feature (467)..(467): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggagcttggtccagccagggcggtccctgagctctcctgtacagcgtctggattcaactttcgtgattatgcctagtcgaactggggtccccgcaggctccgaggggaggggctggagtgggtagttcattagagccatggcttancgctgggacagagaactacgcgctcngtagaaagcagnttcatcatctacaaganatgacttacccgaacggcacgtccgacttactctcgacaagagtagaaacgngaccgtaggaaacgaccgaacggaactacgacgtccgtacttacgttacgtggttaggtttaagggtaacgttttacggttagttttggggattacgggtatttaacgtttaaaccc

SEQ ID NO: 353507 - DNA, 594 bp, Homo sapiens
  misc_feature: GZ8MTXP02IAAP8.4.33.C11.1.454.CMB.2.raw
  modified_base (257)..(257): a, c, t, g, unknown or other
  misc_feature (257)..(257): n is a, c, g, or t
  modified_base (376)..(376): a, c, t, g, unknown or other
  misc_feature (376)..(376): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggggcgaggacgggccaccatcaactgacaagtccagccaggagttgttatatacagcctaccaanaatagaagaacttacttagcttaggatacagacaagaaaccaggacacgccctaccgtaagctcgctcgtaacgtttaccgggcacggtccgtaacccccggggacgtcccggggtccnggacgcgtattcgagtcgcgaggcgggtgtgggacagtattcactctaccacatcagcacgcctgcgaggctaggaaagtgtggtggtacttagtttacttactgttacagtactaaattacttacttaccttaccttcccgtacggttaccgtttacgggaccgggaacgggtaaccgtaagggacggtaagtaacgtaaccgaaacggtaacgtgg

SEQ ID NO: 353508 - DNA, 618 bp, Homo sapiens
  misc_feature: GZ8MTXP02IUSDY.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatcgacccagtctccagactcccgtggctgtgtctcgtgggcgagacgggccaccatcaactgacaagtccagccagagttgttaatatacagctaccaaacaatgaagaactacttagcttaggtatcaagacaaagaaaccgaggaccagccctaccgaagcctagctacgtacgtttaccgggcaacggccgtaacccccggggaactccccggggtcctggacgcgtattccgaggtcggacagggtccgggtactgggactagtactttacgactccgtacaaccctactcgaacgtcgacgtcctaggacgacgtcgtaggaagtagtggtaggtacttagttactagtcgtacagactaattacttcctaactacgtccgttacggtacgtttaccgggacggtaacggaaccgtaaggggtacgaaacgtacgtaaccgaaaacgtaccgtagg

SEQ ID NO: 353509 - DNA, 601 bp, Homo sapiens
  misc_feature: GZ8MTXP02IWEA5.4.33.C11.1.454.CMB.2.raw
  modified_base (255)..(255): a, c, t, g, unknown or other
  misc_feature (255)..(255): n is a, c, g, or t
  modified_base (344)..(344): a, c, t, g, unknown or other
  misc_feature (344)..(344): n is a, c, g, or t
  modified_base (420)..(420): a, c, t, g, unknown or other
  misc_feature (420)..(420): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacgggccaccatcaactgacaagtccagccagagtgttatatacagctaccaaanatgaagaacttacttagcttaggtatcaagacaagaaaccaggaccacgtaccctactaagcctgccttacgtaacgtttacccggggnacggccgtaaccccccggggactcccggggtccctggacgcgtactcgaggtggtacggcggggtcgtggggaacngtacttcactctcacatcagcacgcctagcgaggactaggaagtacgtgtacgggtacttaagtttactacgtgtacagtactaaattacttactacttaccttccggtacggttacgtttcgggacggtacgggaacgaagggttcggaaacgtactaacgaaaacggtacgtcggtagg

SEQ ID NO: 353510 - DNA, 604 bp, Homo sapiens
  misc_feature: GZ8MTXP02FL5AO.4.33.C11.1.454.CMB.2.raw
  modified_base (287)..(287): a, c, t, g, unknown or other
  misc_feature (287)..(287): n is a, c, g, or t
  modified_base (312)..(312): a, c, t, g, unknown or other
  misc_feature (312)..(312): n is a, c, g, or t
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
  modified_base (596)..(596): a, c, t, g, unknown or other
  misc_feature (596)..(596): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtggggggaggcttgggccagccgagggcggtccctgagactctcctgtacagcgtctggattcaactttcgngattatgccatgaacgtgggtcccncgaggcctcggaggggaagggcgtgggaggttggggtaggtttcagttagagccagtggcttagtggctagggaacacgagaataccgccgtcgtntggagaaagcaagtatcatcatctagaaagngaatagaacttacccgaaagggttctccgtacccttaagtcgtacgtacgaagtacgtaacgaaccgtagacccgtaaggaaaaccggacgaacggaaccacgacggtaccctagtacttacgtggttagttagggttacgtttagttagtttaggngtttaagg

SEQ ID NO: 353511 - DNA, 644 bp, Homo sapiens
  misc_feature: GZ8MTXP02GUKVV.4.33.C11.1.454.CMB.2.raw
  modified_base (257)..(257): a, c, t, g, unknown or other
  misc_feature (257)..(257): n is a, c, g, or t
  modified_base (443)..(443): a, c, t, g, unknown or other
  misc_feature (443)..(443): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccagagttgttaatatacagcctaccaaanaatgaataactacttagcttaggatcagacaagaaaccaggacacgtaccctactaagctgcctacgtacgttaccgggcacggtccgtaacccccggggtacgtcccggggtcctaggagtccgtattcgagtggcgagtcggggtagagggactaagtactttaccgactccgtaccacgtaanccgagaccacgccgtcgacgacggacgtaaggtaaagtgtagggtcggtaactttaggtttaactacgttagtacgtagaacttaaactttacttacccttaaacttacccgttaccgtacggttaccggttaccggggaaccggtaaacggggaaccgtaagggtcggaaaataccgaaaacgtaaaacggtacgtacgg

SEQ ID NO: 353512 - DNA, 753 bp, Homo sapiens
  misc_feature: GZ8MTXP02IRH45.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtgggggaggcttggtccagccgagggcggtccctgagactctcctgtacagcgtctggtattctaacttttcgtgtatttagtcgaccctagtacgaaccgtcggggtccccgccgaggtcccgtacccggaagggggaacgggggtcgtggggtagggttcggggtttaggttttccgtaagtttaggaacgtccgtaagtttgggtctttagtcggcgtaggggaaccacgagtaaactaccggcccgtcggtctagggtagaaaagggtcaagtattacgataccattacctacgaaagagtatgtaacgttcccgaaaaccggtctaacgttcccgtaccttacttacccgtggacctaagtaacgtacgaaaaccgacggacccgttaagggaaaaccgaaccggaaaccgggaaacctaaccggaaccgggttcccgttactttaaacgtttaacggttacgggtttaacggggtttttagggggttaaacggttttttaaacggttttaggttttttaaggggtaacggg

SEQ ID NO: 353513 - DNA, 627 bp, Homo sapiens
  misc_feature: GZ8MTXP02I3ZU7.4.33.C11.1.454.CMB.2.raw
  modified_base (375)..(375): a, c, t, g, unknown or other
  misc_feature (375)..(375): n is a, c, g, or t
tcagagcactgtagcacgaccggtgctcgatttagagtgagctcgttgggtttgggcttagctgggttttccttgttgctattttaaaaggtgtccaatgtgaggtgcagctggtggagtctggggggaggcttggtccagccagggcggtccctgagactctcctgtacagcgtctggattcaacttttcgtgattatgccatgaactgggtccgccaggctccgaggggaagggctgggagtgggtagttcattagagcatggcttatgctgggaacaacagaatacgcgcgtctgtagaaaggcagattcatcatctacaaaggagatagacttacccgaaacggctagtcccgcctatctgcagatgaacncgaccgtagaacgacgagacacgagtccgtactattacgtgttaggttagggttagttttaacgtagttttaggagttaggattattacctaaccccttacgtttacgacttacgtcggggaccgtacggggtaaccctcgggtaccgcccgttaccgtcctcgaccgtcccgtacccgaaccgaaccgggcccctaacgttcccggtaacccgttcccccgtcgggtccccgcccgtcggcctaccgacgg

SEQ ID NO: 353514 - DNA, 660 bp, Homo sapiens
  misc_feature: GZ8MTXP02ILCWK.4.33.C11.1.454.CMB.2.raw
tcagagcactgtagcacgaccggtgctcgatttagagtgagctcgttggggtttgggggggagaggagccccagccgtgagattcccaggagtttccacttggtgatcagcactgaacacagaccaccaaccatggagtttgggcttagctgggttttccttgttgcttatttaaaaggtgtccaatgtgaggtgcagctggtggagtcgtggggggaggcttggtccagccgaggggccggtccctgagactctcctggtacagcgtctggattcaacttttcgtgattatgccatgaacttcgggtccgccaggcctccgaggggaaggggctgggaggtggggtaggtttcagtttaggagccagtcgggtactttagcgcgttaggggaaccaaacaggaaactaccgcccggtcgttccgtaggttaggaaacggtcagtagttcatctatctacaaagagtatagacttacccgaaacggctaacgtccgtacctacttcgtgtcctaagacgtagaaacgacgtacccgtaggaaacgaaccgaggaaccacgacgccgttacgtaactttacgtacggtttaggtttaaggggtttaacggttttaacggttacgtttttaggaggttagggttacttaactttaaaccccg

SEQ ID NO: 353515 - DNA, 564 bp, Homo sapiens
  misc_feature: GZ8MTXP02GSRWX.4.33.C11.1.454.CMB.2.raw
  modified_base (180)..(180): a, c, t, g, unknown or other
  misc_feature (180)..(180): n is a, c, g, or t
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
tcagagcactgtagcacgaccggtgctcgatttagagtgagctcggttgggtttggggggagaggagccccagccgtgagattcccaggagtttccacttggtgatcagcactgaacacagacccaccaaccatggagtttgggcttagctgggttttccttgttgctattttaaaaggngtccaatgtgaggtgcagctggtggagtcgtgggggagcttggtcccagcccaggggccggtccctgagactctcctgtacngcgtctggattcaactttcgngattangccatgaactgggccncaggctcgaggggaggctggagtggtagttcatagngccagtggcttagcgctagggacaacgagaactacggccgngtctagtacgaaagtcaaagtnttacatcatctanaaganatagattccgaacgcactcgacttanctgcanactagaacngtacngaaacgccgaaggacaacgatcccgtattacttccgtagttggttaagggttaagtttacgtaagttttagggagttacggattactttaaacccg

SEQ ID NO: 353516 - DNA, 662 bp, Homo sapiens
  misc_feature: GZ8MTXP02GJ832.4.33.C11.1.454.CMB.2.raw
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagcttgggttttccttgttgcttaattttaaaaggtgtccaatgtgaggtgcagctggtggagtcgtgggggagtcttggtccagccgagggccggtccctgacgactctcctgtacngcgtctggattctaactttcgngtatttatgcctagtcgaacgtgggtcccgccgaggcctccggaggggaaggggtcgtagggagggttgggttaggtttacagtttaacgaggtccctagtgggtcctttagtcggcgtaggggaacctaagagaaaacgttccggacccgtcgttacgtaggtaggaaagtctaaagtattacattaccagtacctaagaaagagattacgaacttacccgaaacgggtctaagtcccgacttactcgtacgatagaagtacgaaacgacgaccgtaaggaaaccgaaccggacgaaccgacgacgtcccgtattaacgttgttaggttacggttaaggttagtttaacggtttaggttttaggtaacgg

SEQ ID NO: 353517 - DNA, 627 bp, Homo sapiens
  misc_feature: GZ8MTXP02F4D5P.4.33.C11.1.454.CMB.2.raw
  modified_base (265)..(265): a, c, t, g, unknown or other
  misc_feature (265)..(265): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggcttggtccagccagggcggtccctgagactctcctgtacngcgtctggattcaactttcgtgattatgccatgaactgggtcccgcgacggctccgaggggaaggggcgtggaggtgggtaggtttcagttagagccagtggtcttatgctgggacacgagaatacggcccgcgtcgtgtacgaaagcgaagtattacatcaactctacgaagagatagtaacttaccgaaaccggactacgtcccgtacctactccttacgacaggtaacttacggaaaacgtacgacccgtaaggaaacggaacccggaacgggaaccaacgaccgtaccgtacttaacgttaaccgttggttaacggtttacgggttaggtttttaacggttagtttttaggttaaagg

SEQ ID NO: 353518 - DNA, 548 bp, Homo sapiens
  misc_feature: GZ8MTXP02HFN4J.4.33.C11.1.454.CMB.2.raw
tcagagcactgtagcacgaccggtgctcgatttagagtgagctcgttggggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgtatatacagctaccaaacaatgaagaactacttagcttggtatcagcagaaaccaggacagcctcctaagctagctcacgtttaccgggcacgcctacccccggggaatcccggggtcctgacgcgattccgagtggcgagcgggtctggggacagggtattcactctcaccatcagcagcctgcgagctagaagagtggtaggctagtttatacgtgtacagtacaaattactctacttactaccgttacggtacgtttacgggcggaacgggaaccgaaagggtacggtagaacgtacgaaaacgacgttacgg

SEQ ID NO: 353519 - DNA, 591 bp, Homo sapiens
  misc_feature: GZ8MTXP02H7A91.4.33.C11.1.454.CMB.2.raw
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (381)..(381): a, c, t, g, unknown or other
  misc_feature (381)..(381): n is a, c, g, or t
  modified_base (410)..(410): a, c, t, g, unknown or other
  misc_feature (410)..(410): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtggggggagcttgggtccaggccgagggccggtccctgagacctctcctgtacagcgtctggattcaacttttcgtgtattangccatgaactgggtcccnccgaggctccggaggggaggggcgtagggagtggggttagttcagttagagccagtggctttagngctggggaacagagaataccgccgcgtcngtagaaggcagtatcatcattctacaagagtatagacttaccgaacggctatccgctagtctagactagacgtacgaacgacgtaccgtacggaaccggaaccgaacggaacacgacgtcccgttactacgttaacgtggttacggttacgggttagttttacggttagtttttaggtagg

SEQ ID NO: 353520 - DNA, 756 bp, Homo sapiens
  misc_feature: GZ8MTXP02I2VT4.4.33.C11.1.454.CMB.2.raw
  modified_base (306)..(306): a, c, t, g, unknown or other
  misc_feature (306)..(306): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcgtccctgagactctcctgtacagtcgtctggtacttctaactttcgtgtattatgtcatgaactgggtccncaggctccgaggggaggcgtggaggtgggttagttcaagttacggagtccagtcggtctttagtcgcgtaggggaacaaacgagaaacgtccgccgtcgtcgtaggtaacgaaaggtcaaagtacttacgaacttactaacgttcctaacgaaaggtaagtacgttacggtaaacgtttacccgaaaccgggtacctaacgttaccccgtaccttaacgttccgttacggactaaacggtacgttaacgaaaccgtacggttaacccgtagggaaaaccggaacccggaaacggtaaaaccgaccggtaaccggttacccgttaaacgtttaaacgtttaaccgtttagggtttaacgggtttaagggggttttaaccggtttttaacggtttaacggttttttacggggaaggtttacggttaaacgttttaaccttttaaaacccccg

SEQ ID NO: 353521 - DNA, 654 bp, Homo sapiens
  misc_feature: GZ8MTXP02JJHT4.4.33.C11.1.454.CMB.2.raw
  modified_base (297)..(297): a, c, t, g, unknown or other
  misc_feature (297)..(297): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
tcagagcactgtagcacgaccggtgctcgatttagagtgagctcgttgggtttgggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtgggggaggcttggtccagccagggcggtccctgagactctcctgtacagcgtctggattcaactttcgtgattatgccattgaactcggggtccnccgaggcctccgaggggagggctgggagtggggtagttcattagagcatggcttangctgggacaacagaatacggccngtctgtagaaaacgggcaagtactttcatcatctacaagagaattagacttaccgaaacggtccaacgtccgtacccttattccttgaccgtagaagttacgaaaaccgagtacccgtaggaaacggaccggaacgggaaaccctacggacgacccggttcttaactttaccggttaggtttacgggtttaaacggggttacggtttttaacgttaaggttttttagggaacggtttacgggtaatttaactttaaacccgtaaacccccttttaacg

SEQ ID NO: 353522 - DNA, 557 bp, Homo sapiens
  misc_feature: GZ8MTXP02H0LI4.4.33.C11.1.454.CMB.2.raw
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatcgacccagtctccagacctcctggctgtgtctcgtgggcgagagggccacatcaactgacaagtccagccagagtnttanatacagactaccaanaatgaagaaactacgttagcttaggtatcagacaagaaaaccgaggaacacgacctactaaagcctgacctctaacgtttacccggctacgccgtaacccccggggagtccccggggtccaggacgcgtaattcgagtcgcaggcggtcgtgacgagtacttacactctacaccagtacacgacagccngacgaggctagagtanggtgntagttatactggacagtactaattctacttactactcgtacgtacgttacggaccgaggaaccgtaaggaggtacagtaaccaaacggtactgg

SEQ ID NO: 353523 - DNA, 695 bp, Homo sapiens
  misc_feature: GZ8MTXP02F0EDB.4.33.C11.1.454.CMB.2.raw
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttattttaaaaggtgtccaatgtgaggtgcagctggtggagtcgtgggggaggcttggtccagccgagggcgtccctgagactctcctgtacngcgtntggattcaactttcgngtattatgccagtcgaacgtcgggtacccgccgaggccgtaccggaagggggaacggggtcgtaggggagggttggggttaggttttcaagtttaggacgcctagtcggtctttagtgtcgtaggggaacacgaagaacgtacggcccgtcgttcgtaggtaggaaaacgggctaacggtattaccattacgaacttcctaacgaaagggtaacgtagttaggtaaccctttacccgaaacggtcctaacgttcccggacccttatcccgtagacctagatacgaaaccgacgacccgtaagggaaacccggaaccggacggaacccaacgtacgtaccctatttaacgttaacgttagggtacggttttaacggggttagtttttacggtaaggtttttcggaaagg

SEQ ID NO: 353524 - DNA, 645 bp, Homo sapiens
  misc_feature: GZ8MTXP02I0CMD.4.33.C11.1.454.CMB.2.raw
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttattttaaaaggtgtaccaatgtgaggtgcagctgggtggagtcgtgggggagtcgttggtccaggccgaggggcggtccctgacgactctcctgtacagcgtctggtattcaactttcgngatttancgaccatcgaacgtgggtcccnccgaggcctccggaggggacgggcgtgggaggttggggttagtttcagttagacgtctagtcggtacttagcgcgtagggaactagagtaaacgtaccggccgtcgtacgtgtaaggaaacggctaagtacttacagtctaacttcgtaacgaaagtacgtatagtaaccttacccgaaacggtctacgtcccgtaccttaatccgtgacagactacgaaactacgacgtaacgaacggaccggtacgacacgacgtacctacttaacgttaacgttggttaaggtttacggggttacttttacggttagttttacggaag

SEQ ID NO: 353525 - DNA, 585 bp, Homo sapiens
  misc_feature: GZ8MTXP02FNYHH.4.33.C11.1.454.CMB.2.raw
  modified_base (239)..(239): a, c, t, g, unknown or other
  misc_feature (239)..(239): n is a, c, g, or t
  modified_base (325)..(325): a, c, t, g, unknown or other
  misc_feature (325)..(325): n is a, c, g, or t
  modified_base (417)..(417): a, c, t, g, unknown or other
  misc_feature (417)..(417): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagagtgttanatacagctacaacaatgaagaactacttagcttaggatcagacaagaaaccaggacagcctactaagctgctacgtattaccgggnacggccgtaacccccggggaatccccggggtcctaggacgcgtattcgagtcggacagggccggggtctaggggaactagtactttcactcncacctatccaagctacgccgtgacgtaggctaggaagtagtaggtggactagtttattactgtacagtactaaattacttacttaacttaacctccgttacgtaccgtttcgggacggtaacgggaaccgtaaaggtcggaacgtactaacgaaaaccgtacgtacgg

SEQ ID NO: 353526 - DNA, 541 bp, Homo sapiens
  misc_feature: GZ8MTXP02HQ9QA.4.33.C11.1.454.CMB.2.raw
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccacatcaactgcaagtccagccagagtgttanatacagctaccaanatgaanaactcttagcttggtatcagcaagaaaccaggacagcctctaagctgctactagttaccgggcaggccgtacccccggggaatcccggggtcctgacgcggattccgaggtggaccagggcgggtctagggactagtactttcactctacacatcagcagcctgacaggctagaagntgggagtnttagtttatacgtgtacatactaattacttactactactccgtacggtacgttcggacggacggaacgaagggtgaacgtactacgaaaacgtacgtg

SEQ ID NO: 353527 - DNA, 723 bp, Homo sapiens
  misc_feature: GZ8MTXP02F2YFQ.4.33.C11.1.454.CMB.2.raw
  modified_base (320)..(320): a, c, t, g, unknown or other
  misc_feature (320)..(320): n is a, c, g, or t
  modified_base (480)..(480): a, c, t, g, unknown or other
  misc_feature (480)..(480): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgcttattttaaaaggtgtccaatgtgaggtgcagctggtggagtcgtgggggagcttggtccagccgagggcggtccctgagactctcctgtacagcgtctggattctaactttgagtattatcgacctagtcggaacgtcggggtccccnccgaagggtccctacccgggaagggggtaacggggtctaggggaacgggttgggggttaacggtttttcaaagtttaaggacggtcctaagttcggggtacctttaagtcggacggttacggggaacctaacgaagaaacgttaccggcccgtacggttntacgggtaaggaaacgggtctaaaggtatttaccaatttaccaacttaccttaacgaaagtaaggtactacgggtaaaccttaacccgaaacggtctaacgttcccgtaccttacttccgtaggacaaggtacacgaaacgacgtacccgaaggaaaccggacgaaacggaccacgaccgtacccgtattacgttaacgttggtaggttaacggggttagtttacggttagttttaggtaagg

SEQ ID NO: 353528 - DNA, 629 bp, Homo sapiens
  misc_feature: GZ8MTXP02F9JLK.4.33.C11.1.454.CMB.2.raw
  modified_base (441)..(441): a, c, t, g, unknown or other
  misc_feature (441)..(441): n is a, c, g, or t
tcagagcactgtagcacgaccggtgctcgatttagagtgagctcgttgggtttgggggggagaggagccccagccgtgagattcccaggagtttccacttggtgatcagcactgaacacagacccaccaaccatggagtttgggcttagctgggttttccttgttgctattttaaaaggtgtccaatgtgaggtgcagctggtggagtcgtgggggaggcttggtccagccagggcggtccctgagactctcctgtacagcgtctggattcaacttttcgtgtattatgccatgaactcggggtccgccaggcctccgaggggaagggctggaggtggggtagtttcagttaggagccatggcttagtcgctaggggaacaaacagaaacttacggcccgtcgtctaggtagaaaaggcaaggtattcatcctaatcctanaaagagatagacttaccgaaacggcaagtccgacctatctgacgaagacgtagaacacgtaccgaggaaacgacccggaaggaaccacgacggtccgttacttactttacgttaggttaggtttaaggggttaacgtttttacggttagtttttagggaggtttacggtaatttaactttaaaccccg

SEQ ID NO: 353529 - DNA, 566 bp, Homo sapiens
  misc_feature: GZ8MTXP02FSKOX.4.33.C11.1.454.CMB.2.raw
  modified_base (269)..(269): a, c, t, g, unknown or other
  misc_feature (269)..(269): n is a, c, g, or t
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggcttggtccagccgagggcggtccctgacgactctctgtaccccngcgtctggattcaactttcgngattatgccatgaactgggtccncaggctcgagggaggctggagtggtagttcattagagccatggtcttagtgcgtagggacacagaactacgccgtcgtntgtagaaagcagntcatcatctacgaagngatgtacttaccaacggcagtccgacctatcgtgacgatagtagaacagacccgtaggaaacgaccggaacgaaccacgacgtaccgtacttacgttaacgttaggtaggtttacgggtagtttttacgtagtttttaggtaagg

SEQ ID NO: 353530 - DNA, 571 bp, Homo sapiens
  misc_feature: GZ8MTXP02HRUIS.4.33.C11.1.454.CMB.2.raw
  modified_base (183)..(183): a, c, t, g, unknown or other
  misc_feature (183)..(183): n is a, c, g, or t
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
  modified_base (490)..(490): a, c, t, g, unknown or other
  misc_feature (490)..(490): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttcctgttgctattttaaaggtntccaatgtgaggtgcagctggtggagtcgtgggggagcttggtccagccgagggcggtccctgagactctcctgtacngcgtctggattctaactttcgtagatttatgcccatgaacgtgggtcccnccgaggctccggaggggagggctgggagttggggtagtttcagttagagcctagtggctttagcgcgtgggaacacgagaactaccggcccgtcgtctaggtagaaagtcagtattcatcatctagaagagatgtattaccgaacgactacgtccgtacctatcgtgacagatagaacngaccgagaacgaccgacgacacgacgaccgtactattaacgtggttaggtttacggtagttttacgtaggttttggtaagg

SEQ ID NO: 353531 - DNA, 662 bp, Homo sapiens
  misc_feature: GZ8MTXP02HINQ2.4.33.C11.1.454.CMB.2.raw
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (391)..(391): a, c, t, g, unknown or other
  misc_feature (391)..(391): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttaattttaaaaggtgtaccaatgtgaggtgcagctggtggagtcgtgggggagcttggtccagccgagggcgtccctgagactctcctgtacngctctggattcaactttcgngattatcgcctagtgaaccgtgggtcccgccaggcctccgaaggggacggggcgtagggaggttggggttagtttcaagtttacgagtcaagtggtactttagngcgtaggggaacaacgagtaaacgtaccgccgcgttactagggtagaaaacgggtcaaagtacttacattaccagttcctaagaagtaaggattcgtaacttaccccgaaaagggcctaacgtcccgtacccttaatcccgtaggacctaaaggtacaacgaacgaacgaccgacgaacggaaccggaacggaaccgaaccgacgaccgtacttacgttaacgttagttacggtttacggttaggtttaacggtttagtttaggtttaagg

SEQ ID NO: 353532 - DNA, 561 bp, Homo sapiens
  misc_feature: GZ8MTXP02GW2BW.4.33.C11.1.454.CMB.2.raw
  modified_base (239)..(239): a, c, t, g, unknown or other
  misc_feature (239)..(239): n is a, c, g, or t
  modified_base (416)..(416): a, c, t, g, unknown or other
  misc_feature (416)..(416): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagtgttanatacagctaccaaacaatgaagaactacttagcttaggtatcagacaagaaaccgaggacacgtccctactaagctgctactacgtttaccgggcacgccgtaacccccggggagtcccggggtccctaggacgcgtattcgagtggcaggcgggtacgtgggacagtcttcactcncacatcagcacgcctgacgaggctaggaagtagtgggtagacgttagtttacttacgtcgtactagactaattacttacctacttactccgtacggtcgttcggacggacggtaacgaggtacggacactaacgaaacgtagtgg

SEQ ID NO: 353533 - DNA, 625 bp, Homo sapiens
  misc_feature: GZ8MTXP02GHUCP.4.33.C11.1.454.CMB.2.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (413)..(413): a, c, t, g, unknown or other
  misc_feature (413)..(413): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgcttattttaaaaggtgtccaatgtgaggtgcagctgggtggagtcgtgggggagcttggccagccgagggcggtccctgagactctcctgtacagcgtctggattcaactttcgngtattangccatgaactgggtccncgaggctcgagggagggctggagtgggtagtttcagttagngcagtggacttangcgtagggaacacgagaaactccggccgtccgtcgtgtagaaaggcaagntacatcatacctacaagacgatcgtaattacccgaaaggctacgtaccgtacctaatccgtagacgaggtaactagaaacacgaccgtaggaaaacggaacccggaaagggaaccaacgacggtaccccgtacgttaaacgtttaacgttagggtttaacggtttaagggggttacgtttttaaaacggttaggttttttacgggtaaaggg

SEQ ID NO: 353534 - DNA, 781 bp, Homo sapiens
  misc_feature: GZ8MTXP02GWVUY.4.33.C11.1.454.CMB.2.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatacaactgacaagtccagccagagtgttanatacagcctaccaaanaatgaagaactacttagcttggtatcagacaagaaaccaggaccacgccctactaagctgctactacgtttaccggggcacggtccgtaacccccccggggtaacgttccccgggggtaccctacggacggtaccgttaaagttcccggaagggttcgggggacccgtaacgggggtcccgggggtttacggtacggggggaaacccttaaacgggttaacctttttaccccgaaccgttcccttaacccgaaacccctaaacgttcccgaaacggtcccgaaccggtcccgttacggaccggaacgggtaccgttaaggaaaggtagttgggtacgggtaacctttaaaggttttacttaccgttagtacgtaacgtaccttaaaatttaccttacttaacccttacccgttcccggttaccggttaaccggggtttcccggggaacggggttaaccggggaaccggtaaaggggtacggtaaacggtaaccgtaaaccgtaaaaccggtacgtttacgggg

SEQ ID NO: 353535 - DNA, 622 bp, Homo sapiens
  misc_feature: GZ8MTXP02H4K8N.4.33.C11.1.454.CMB.2.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (379)..(379): a, c, t, g, unknown or other
  misc_feature (379)..(379): n is a, c, g, or t
  modified_base (410)..(410): a, c, t, g, unknown or other
  misc_feature (410)..(410): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagcttgggttttcctgttgcttattttaaaaggtgtaccaatgtgaggtgcagcgtgggtggagtcgtgggggaggtcttggtccaggccgaggggccgtccctgagtactctcctgtacngcgtctggattcaactttcgtgatttangccatgaactgggtcccnccgaggcctaccgaggggaggtctgggagtgggttagttcagttagacgtcagtggcttangtcgtagggaaccagagtaaactccggaccngttctaggtaagaaagcagtattacatctattcacgaaagagagtagtacttacccgaaacgggtacctacgtaccgtaccttaacgttccgttacgacgtaagaacgttacgaaacgacggtacctacggaaacggaccgaacggaaccaacgacgtaccgtactagttaacgtgttacggttagggttagtttacgttagttttggaagg

SEQ ID NO: 353536 - DNA, 564 bp, Homo sapiens
  misc_feature: GZ8MTXP02I6NX4.4.33.C11.1.454.CMB.2.raw
  modified_base (258)..(258): a, c, t, g, unknown or other
  misc_feature (258)..(258): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgacaagtccagccagagtgttatatacagcctacaacaatgaanaactactagcttggatcagcaagaaaccaggacagccctactaagctgctactacgtttaccgggcaggtaccgtaaccccccggggaagttcccgggggtaccctaggacgccgtatttccgaggttcggcgagccggggtcgtagggacctagtactttccactctacacatcagcacgctgcagctagaagtatggtagcttagtttactcgttagtcagtactaattacttactacctacttccgtacggtacgttacggcgaaggtaaccgaaggtacgacgtagtaacgaacgtacgtcg

SEQ ID NO: 353537 - DNA, 721 bp, Homo sapiens
  misc_feature: GZ8MTXP02GJMJM.4.33.C11.1.454.CMB.2.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (317)..(317): a, c, t, g, unknown or other
  misc_feature (317)..(317): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttaattttaaaaggtgtccaatgtgaggtncagctggtggagtcgtgggggagcttggccagccgagggccggtccctgagactctccgtgtacagcgtctggattcaactttcgngtattatgaccagtgaacgtgggtcccncgaggctccgaaggggagggctgggaggttggggttagtttcaagttagacgtccagttcggtctttaagcgacgttaggggaacctaacgagtaaacgtaccggccgtcgttacgtagggtaaacggaaagggctaaaggtatttaccaattacccaattcctaacgaaaaggtagtatagtaacttacccgaaacgggtctaaacgtcccgtaccttaattcccgtaggtaccaagtaacgttaacggaaaccgaacggtaccccgtaaagggaaaacccgggaaacccggtaagggaaacccaacggtaaccggtcccgttaaacctttaagtttaaccggttcggtttaggggtttaaaccgggtttagtttttaacggtttaggtttttagggtaacgg

SEQ ID NO: 353538 - DNA, 620 bp, Homo sapiens
  misc_feature: GZ8MTXP02JNSN0.4.33.C11.1.454.CMB.2.raw
  modified_base (241)..(241): a, c, t, g, unknown or other
  misc_feature (241)..(241): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggccaccatcaactgacaagtccagccagagtgttanatacagcctcaaacatgagaactacttagcttggtatcgagcaagaaaccaggacagccctactaagctgctactacgtttaccgggcacggtaccgtaaccccccggggagtccccggggtacctaggacgcgattcgaggtggacgagggtcgggtcgtgggaccagtcttacgactcacaccatcgaagcacgtcctggacagggactaggaaagtcgtacgggtgggtaccttaagtttacgttacgtcggtacctagtaactaattactttacgtaccttaccgtaccgttacggtaacggtttccggggaacgggttacgggaaccgtaaggggttacggaaacgtacgtaaccgtaaacggtacgttacggg

SEQ ID NO: 353539 - DNA, 632 bp, Homo sapiens
  misc_feature: GZ8MTXP02INZJP.4.33.C11.1.454.CMB.2.raw
  modified_base (313)..(313): a, c, t, g, unknown or other
  misc_feature (313)..(313): n is a, c, g, or t
  modified_base (373)..(373): a, c, t, g, unknown or other
  misc_feature (373)..(373): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtgggggaggtcttggtccagccgagggcggtcctgagctctcctgtacagcgtctggtattcaactttcgtgtattatgccatgaacgtgggtcccncgaggctaccgaggggagggctggaggttcgggttagttcattagagcctagtgcttagngctagggaacagagaactaccggccgtcgttcgtaggtacgaaaggcagtattacatactattcctaacgaaaggtaagtagttacgtaacgtttacccgaaaccggactactcccggtaccttaacgtctacgacagatagaaacgacgacctaacggaacggaccggaaacggaaccacgacgtaccgttacttacttaacgttaggttacggtttaaggggttaacgtttttacggtttaggtttttacggtaagg

SEQ ID NO: 353540 - DNA, 775 bp, Homo sapiens
  misc_feature: GZ8MTXP02HWIM4.4.33.C11.1.454.CMB.2.raw
  modified_base (296)..(296): a, c, t, g, unknown or other
  misc_feature (296)..(296): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctgggtggagtcgtgggggagcttggtccagccgagggccgtccctgagactctcctgtacagcgtctggattcaacttttcgtgatttacncgacctagtacgtacgtcggggtcccgccggacggccgtaccgggaagggggacggggtcgttaggggtagggtttaggggtttacggtttacgaagttaacggacgtaccgtagttcggttactttagtcgggtacgtacggggaaacctaacgtaaggtaaaccgtacccggtcccggtcgttacgttaggtaaacgggaaacgtacgtaagtacgttactaactactacttaccgtaacgtaaaggtaagtagttacgtaccgttaacccgaaccggtacttaacgtacccgtaccgtacgttacgtacgacgtaacgtaacgtacgaaaccgtacgtaaccgtaaacggaaaacggaaccggaacggaaaccgtaaccgtaccggtaccgttacgttaacgtttaacggttacggtttaacggggttttaacgggtttaacgtttttaacggtttacggtttttacgggtaacgg

SEQ ID NO: 353541 - DNA, 636 bp, Homo sapiens
  misc_feature: GZ8MTXP02HXVLE.4.33.C11.1.454.CMB.2.raw
  modified_base (252)..(252): a, c, t, g, unknown or other
  misc_feature (252)..(252): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctcccgtggctgtgtctcgtgggcagacgggccaccatcaactgacaagtcagccagagtgtatatacagctaccaanatagaagaactacttagcttaggtactcgagacaacgaaaccgagacacgcctacaagctgctacagttaccggacacgtaccgtacccccggggacgtcccggggtaccctggacgcgtattcgaggtcgacgacgggtcggtacgtaggacctagtacttaccgactcacaccatacagcacgtcctagaccgaggactaggaagacgtgggtacgtacgttaaggtttacttacgtgtaaccgtagtaccttaaaattactaccgtttaaccacccgtttaccgtaccgggttaccgttaccgggggaccggtaacgggtaacccggtaaagggtacggtaaaacgtaaccgttaaaccggaaaacccgttaagtccgggg

SEQ ID NO: 353542 - DNA, 654 bp, Homo sapiens
  misc_feature: GZ8MTXP02GGAAR.4.33.C11.1.454.CMB.2.raw
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggccagccgagggccggtccctgagactctctgtacagcgtctggtattctaactttcgtgattatcgccatgaacgtcgggtcccgccgaggcctccgaggggaaggggctgggaggttgggtaggtttcagttagagccagtggtcttagcgcgtagggacaacgaagaacgtacgccgtctcgtaggtagaaaaggctaagtacttacatacactactacgaaagtagatacgtaacttaccgaaacggctaacgtccgtaccttagtccgtagaccgagaagtacggaaacacggtacccgaaggaaacgaacccggaacggtaaccgaacgacgtaccccggttattaaacgttaccgttaggttagggtttaagggttaagttttaacgtagtttttagggagtttaggtactttaaactttaacccc

SEQ ID NO: 353543 - DNA, 504 bp, Homo sapiens
  misc_feature: GZ8MTXP02FKHMJ.4.33.C11.1.454.CMB.2.raw
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
  modified_base (314)..(314): a, c, t, g, unknown or other
  misc_feature (314)..(314): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagatgttatatacagctcaacaatganaactactagcttggtatcagcagaaaccnggacagcctcctaagctgctcatttaccgggnagctaccccgggaatccggggtcctgagcgattcagtgcagcggtctgggacagatttcaactcttcaacccagcagcagcctcgcaggctagaagagtgtgcgtagttattatntnanataatacttactactactcctcgtacgttcgtcggacggaacgaacgtacggacgagacgaacgaacgtag

SEQ ID NO: 353544 - DNA, 850 bp, Homo sapiens
  misc_feature: GZ8MTXP02JX77B.4.33.C11.1.454.CMB.2.raw
  modified_base (195)..(195): a, c, t, g, unknown or other
  misc_feature (195)..(195): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagcttgggttttccttgttgcttattttaaaaggtgtccaatgtgaggtncagctgggtggagtcgtgggggagcttggccagccgagggcgtcctgagactctctgtacagcgttctggtattactaacttttcgtagtattatcgacctagttaggaaccgttcggggtccccgaccgaagggtcccgtaccccggaaggggggaaacgggggtcgtaggggtaacggggtttagggggtttaacggttttaccgaaaggttttaacggacggtacccgtaaagttcggggtacctttaagtccggtacggttacggggaaaaccaaaacgacggtaaaacgttacccgggccggtaccggttcgtacgggttaaggaaaacgggcctaaagggttaaactttaccgtaaacgttacctaaacgttaccgtaacgaaaagtaaaggtacttacggtaaaccgtttaacccgaaaccgggtacctaccgttacccggtacccttaacgttccgttacgacccgtaaaggtacttaacggaaaccgacggtaccccgtaaggggaaaaccggaaccggtaacggggaaaccaaccgtaccggtaccgtttaaccgtaagtttaccgttacggttaaggtttaaggggttaacgtttttacggttacgtttttagggagttaggttaacttaacgtttaaaccccg

SEQ ID NO: 353545 - DNA, 608 bp, Homo sapiens
  misc_feature: GZ8MTXP02GN9S7.4.33.C11.1.454.CMB.2.raw
  modified_base (123)..(123): a, c, t, g, unknown or other
  misc_feature (123)..(123): n is a, c, g, or t
  modified_base (263)..(263): a, c, t, g, unknown or other
  misc_feature (263)..(263): n is a, c, g, or t
  modified_base (336)..(336): a, c, t, g, unknown or other
  misc_feature (336)..(336): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (428)..(429): a, c, t, g, unknown or other
  misc_feature (428)..(429): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttnctctggatctctggtgcctacggggacatcgtgatgacccagtctccagacctccctggctgtgtcctcgtgggcgaggacgggccaccatcaactgacaagtccagccagagtgttatatacagcctacaaacatgaanaactacttaagcttaggatcgaagaccaaagaaaccaggacacgcctactaagctgctactacgttaccgggnaccgtcgtaaccccgggactcccggggtcctggacncggtattcggnggcggcgacggtcggtcgaggactagtacttccnctcacacnacnncgacgtcgagcgacggtactagaagtgtcggtacgtacgtttacgtttactacgtacgtacgaactaacttaactttaccttaccgttaccttaccgttaccggttacggttacggtcccgggaacggtaacggaacggtaacggaggtaaccgaaactaaccggtaaaacgtcgtcgg

SEQ ID NO: 353546 - DNA, 657 bp, Homo sapiens
  misc_feature: GZ8MTXP02J3BAQ.4.33.C11.1.454.CMB.2.raw
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
  modified_base (361)..(361): a, c, t, g, unknown or other
  misc_feature (361)..(361): n is a, c, g, or t
tcagagcactgtagcacgaccggtgctcgatttagagtgagctcgttgggtttgggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctggggagcttggccagccagggcgtcctgacgactctcctgtacngcgtctggattcaactttcgngtattangacctatacgaacgtcgggtcccncgaggctacggagggagggtctggaggttgggtagtttcagttgagtccgtagtggtctttaagnggactaggggaacaacgagaactacggcccgtcgtcgtggtacgaaaggctaagactttacatctaattcgacgaaagacgtaatacggtacttacccgaacggtacctacgtaccgtaccctatccgtagacctaagacgtaacgaaacgacgtaccgaaggaaacggaccggagaaacccgacgacggtacccgttagttacgttaacgttcggtttacggttaaggtttaacgttttacggtaagtttttacggagttacggtaacttactttaaacccgtaccccctttaag

SEQ ID NO: 353547 - DNA, 594 bp, Homo sapiens
  misc_feature: GZ8MTXP02HH0NI.4.33.C11.1.454.CMB.2.raw
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttaattttaaaaggtgtccaatgtgaggtgcagctgggtggagtcgtgggggagcttggtccagccgaggggccgtccctgagacctctcctgtacagcgtctggattcaactttcgngtattangccagtttgaaccgtgggtcccncgaggcctaccggaggggagggcgtgggaggttggggttagtttcaagttaggacgtccagtggtacttagtcgcgtagggaacaacgagaaactaccggccgtcgtcgtagtaggaaaggcaagtattcatcatccanaaganatgtactaccgaacggctatccgtactatccgtgacagatacgaacacgactaaggaacgacggaacgacacacgtaccgtacttataacgtgttaggttacggttagtttacgttaggttttaggtagg

SEQ ID NO: 353548 - DNA, 591 bp, Homo sapiens
  misc_feature: GZ8MTXP02H45BG.4.33.C11.1.454.CMB.2.raw
  modified_base (236)..(236): a, c, t, g, unknown or other
  misc_feature (236)..(236): n is a, c, g, or t
  modified_base (289)..(289): a, c, t, g, unknown or other
  misc_feature (289)..(289): n is a, c, g, or t
tcagagcactgtagcacgaccggtgctcgatttagagtgagctcgttgggtttgggggagctacaacaggcaggcagggcagcaagatggtgttgcagacccaggtcttcatttctctgttgctctggatctctggtgcctacggggacatcgttatgacccagtctccagacctcctggctgtgtctcgtgggcgaggaggccacatccaactgcaagtccagccagagtgttanatacagctaccaaacaatgagaaactacttagcttggtatcagcaagaaaccnggaacagccctacctaagctgcctctaacgtttacccgggcaggccgtacccggggaacgttccccggggtccctgagcgattcgaggtgcgaggccggggtctgggggacaggtactttcaccttctacacccatcgagcacgccctgccgaggcctaggaagtatggtcgggtactaagttttaacttacgttgtacgatactaaattacttacttaactaccgttccgttaccgggtactttcggggacggacgggtaaccgaaggtaggacggtaactacgaaaacgtacgtggtacg

SEQ ID NO: 353549 - DNA, 669 bp, Homo sapiens
  misc_feature: GZ8MTXP02JWW8L.4.33.C11.1.454.CMB.2.raw
  modified_base (282)..(282): a, c, t, g, unknown or other
  misc_feature (282)..(282): n is a, c, g, or t
  modified_base (519)..(519): a, c, t, g, unknown or other
  misc_feature (519)..(519): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttggccttagcttgggttttccttgttgcttaattttaaaaggtgtccaatgtgaggtgcagctggtggagtcgtgggggagcttggccagccgagggcgtccctgagactctcctgtacagcgtctggtattctaactttcgngtattagcgccagttacgaacgttcgggtcccgccgaggcctaccggagggggaacggggcgtagggtaggttggggttaggttttacagtttagacgctagtggactttagcggacgtaggaacaaacgtagaacgtaccggccggtacgtacgtaggtaaggaaacggactaagtacttacactactactactaacgaagtagtactagtaactaccgacgtactactcctactntcagactaagacacgaacgagtaccgaaggaacgacgacgtaaccacgacgtaccgttataacgttacggtaggtttaaggttaacgggtttaagtttttacggtttaggttttaggagtttacggttaaactttaaccgtttaaacccg

SEQ ID NO: 353550 - DNA, 732 bp, Homo sapiens
  misc_feature: GZ8MTXP02FOBI9.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtctccagacctcccgtggctgtgtctcgtgggcgagacgggccacatcaactgacaagtccagccagtagtgttaatagtacagacctaccaaacaatgaagtaaactacgttagcttaggtactacgagacaacgaaaccgaggaccacgtccctacgtaagctagctactacgttaccggggacacgaccggtaacccccgggtaacgtccccggggtccctaggacgacccgtagtttcgagggtcggacgtacgggtccggggttgacggggaactacgttacgtttacccaccgttacctaccaaacccgtacgtacccaacggacccaacgcccgtaggacccgtaggaccggttaacggaaggtagttaccgggtaggttaccgtttaaggttttaaccttacgttacgaacgtaaaccgtattaaaacgtttaactttcccgttaaaaccttcccgtttacccggtaccgggtttacgtttaccgggggacggggttaaaaccgggaaccgttaaggggacgtaaacggtacgttaaacggaaaaccgtagttacggg

SEQ ID NO: 353551 - DNA, 790 bp, Homo sapiens
  misc_feature: GZ8MTXP02F5MCE.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatcgacccagtctccagacctcccgtggctgtgtctcgtgggcgaggacgggccaccatcaactgacaagtccagccagagtgttatatacagcctaccaacaatgaagtaactacttagtcttaggtatcagacaacgaaacccgaggaacacgtaccctacaagtctctcctacgttaccgttaccgggcaaccggtaccggtaaccccccggggtaccggttcccccggggtaccgtaggacggtacgttacgttccgggacggtcgggacgacggggtccggggttacggtacgggggaactaggttaccctttaccgaaccctttccgaaccctaaccttacgcccgaaaggcccgtaaccggtcctacggaacccggtaggtaccgttaaggggaaagttggtacggggttacggtaaacctttaaggtttttaaccgtaccgttaaggtactaaacggtaaacttaaacgtttactttaacccgtttaaaccctaacccggtttcccggttaacccgggtttacggtttaacccgggggaaccggggttaaacgggaaacccgggttaaaaggtacgggaaaacgttaaccggtaaaaaccgtaacccgggtagtttaaccggggg

SEQ ID NO: 353552 - DNA, 552 bp, Homo sapiens
  misc_feature: GZ8MTXP02JHC4S.4.33.C11.1.454.CMB.2.raw
  modified_base (237)..(237): a, c, t, g, unknown or other
  misc_feature (237)..(237): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtcctccagactccctggctgtgtctcgtgggcgaggacgggccaccatcaactgacaagtccagccagagtnttaatatacagcctaccaaacaatgaagtaaactacttagcttaggtatcagacaaagaaaccaggacagccctacaagctgctctacgttaccggcacgccgtacccccgggacgtcccgggtcctggacgcgacttccgagtggccgaggcgggtcgngggacagtacttcactcctcaccatcagcagtcngacgngctagacgngtcgagtacttagtttactgtntacganactaattcttaccttactacctccgtcggttaccgttcggacggacggaacgaaggtacgacgactaacgaagtacgtg

SEQ ID NO: 353553 - DNA, 498 bp, Homo sapiens
  misc_feature: GZ8MTXP02HBYXO.4.33.C11.1.454.CMB.2.raw
  modified_base (417)..(417): a, c, t, g, unknown or other
  misc_feature (417)..(417): n is a, c, g, or t
  modified_base (456)..(456): a, c, t, g, unknown or other
  misc_feature (456)..(456): n is a, c, g, or t
  modified_base (486)..(486): a, c, t, g, unknown or other
  misc_feature (486)..(486): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaaacaatgagaactacttagcttggtatcagcaagaaaccaggacagccctacaagctgctcatttaccgggcagctacccccgggatcccggggtcctgagcgattcgagtggcagcgggtctgggacagatttcactctcaccatcagcagcctgcaggctgaagatgngctagtttactactgtcagctaatattactactactccncggtacgttcggcggacggaacgaggtganatacaaacgatg

SEQ ID NO: 353554 - DNA, 560 bp, Homo sapiens
  misc_feature: GZ8MTXP02FJZFR.4.33.C11.1.454.CMB.2.raw
  modified_base (313)..(313): a, c, t, g, unknown or other
  misc_feature (313)..(313): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (415)..(415): a, c, t, g, unknown or other
  misc_feature (415)..(415): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgctattttaaaaggtgtccaatgtgaggtgcagctggtggagtcgtgggggaggtcttggtccagccagggccggtccctgagactctcctgtacagcgtctggattcaactttcgtgattatgccatgaacgtgggtcccncaggctccgaggggagggctgggagtgggtagtttcattagagccatggcttangctggacanagaatcgccgngtctgtagaaagcagattcatcatctanaagagatgaattacccaaaggcaactcgtaccctatcctgacaggatacggaacacgccgtagaacggaaccgacgggaacacgacgtacccgtcttataacgttggttacggttagggttagttttacgtagtttttaggaagg

SEQ ID NO: 353555 - DNA, 607 bp, Homo sapiens
  misc_feature: GZ8MTXP02F6QLB.4.33.C11.1.454.CMB.2.raw
  modified_base (261)..(261): a, c, t, g, unknown or other
  misc_feature (261)..(261): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttcctgttgctattttaaaaggtgtccaatgtgaggtgcagctggtggagtctgggggagcttggtccagccagggcggtccctgagactctcctgtacngcgtctggattcaactttcgtgattatgccatgaactgggtccgccaggctccgaggggaaggggctggagtggggtagtttcattagngccagtggcttatgctggggacacagaataccgccgngtcgtgtagaaaggcagattcatcatctacaaagtagatggacttaccgaaacggcagtaccgtccttaatccctggaccaaggtatacggaaaacacggtacccgttaaggaaaacggaacccggaacgggaaaccaaccgacggtacccgttacgttaactttaaccgttggttagggtttacggggttagtttttaacggtagtttttaggggtaag

SEQ ID NO: 353556 - DNA, 661 bp, Homo sapiens
  misc_feature: GZ8MTXP02IM6ZP.4.33.C11.1.454.CMB.2.raw
  modified_base (237)..(237): a, c, t, g, unknown or other
  misc_feature (237)..(237): n is a, c, g, or t
tcagagcactgtagcacgaccggtgctcgatttagagtgagctcgttgggtttgggggagtgtgaggggacatgagtggtagaaacagtggatatgtgtggcagtgtctgaccttggttgttttttgtttgtaggtgtccaatgtgaggtgcagctgggtggagtcgtgggggagcttggtccagccaggggcgtccctgagactctcctgtacagcgtctggattcaacttttcgngtattatgccatgaacgtgggtcccgcaggctacgaggggagggctggagtggtagttcattagagcatggtcttatgacgtggaacaacgaagaacgtaccgccgtcgttcgtaggtacgaaacggccaagtacttacatcaatcgtacaagagatagacttaccgaaacggactacgtccgtactaactcgtagctaaggatacgaaacacgaccgtaaggaaacgaaccggaacggaaccaccgacggtacccgttacttaacgtttacgtaggtttagggttaaagggtttacgttttaaggttaggtttttacggaagtttaggtaactttaacttaacccgtaaacccctttacgttacgtaacgtaacggtcggggtacccgtaacggggtaaccgtcggtacccgtaccggttccg

SEQ ID NO: 353557 - DNA, 578 bp, Homo sapiens
  misc_feature: GZ8MTXP02HXKXB.4.33.C11.1.454.CMB.2.raw
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtgggggaggcttgggtccagccaggggccggtccctgagacctctcctgtacagcgtctggattcaactttcgngatttangccatgaacgtgggtcccncgaggcctccgaggggaggggctgggagtggggttagttcagttagngtccagtggtcttangcgtagggacacgagaaactccgccgtctcgtagtaggaaagcagtattcatcatctacaagagatagacttaccgaacggtctagtccgtactatctgacagatagaacacgaccgtaagaacgaccggacgacacgacgtcctatacgttaacgttggttaggttacgggtagttttacggttagtttttaggtaagg

SEQ ID NO: 353558 - DNA, 733 bp, Homo sapiens
  misc_feature: GZ8MTXP02H7OL2.4.33.C11.1.454.CMB.2.raw
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
  modified_base (394)..(394): a, c, t, g, unknown or other
  misc_feature (394)..(394): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctatttaaaggtgtccaatgtgaggtgcagctggtggagtcgtggggggaggcttggtccagccgaggggccggtccctgagactctcctgtacngcgtctggattcaactttcgtnattatgccatacgaaccgtggggtccccgccgacgggcctaccggaagggggaacggggcgtaggggaggttggggttaggttttcagttaggacgcctagtcggctttagngcgtagggaacaaacgagaacgtaccgccgtcgttcaggttagaaaacggcaagtacttacagtacctagtacctacgaaaagagtattacgaaaccgtttacccgaaacgggtcctaaacgttcccggtaccttaactcgtacggaccgtaacggtaagtaacggaaactacggtaaccccgtaaggggaaaaccgaacccgggaaacggaccctaaccggaacgtccccggttaaattaacgtttaccgtaggtttacgggtttaacggggttaaggtttttacggttaaggtttttacgggaggtttaggttaaactttaaacctttaaacccccg

SEQ ID NO: 353559 - DNA, 591 bp, Homo sapiens
  misc_feature: GZ8MTXP02FYI6H.4.33.C11.1.454.CMB.2.raw
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgacaagtccagccagagtgttatatacagctaccaaacaatgaagaactactagcttggtatcagcaagaaaccaggacagccctcaagctgctactacgtttaccgggctacggaccgtacccccggggaacgtccccggggtaccctggacgcgattccgaggtcggcgacggcggggtcgtaggggactagtactttaccgactccgtcaacctatccaagccacgccctgaccgtaggctaggaagtagtggtcggtacttagtttactacgtaggtacagtactaattacttactaccgttacctccgtacggtcgtttacgggcggtaacggaaccgtaggtaggacacgtaacgaaacgtagtcgg

SEQ ID NO: 353560 - DNA, 685 bp, Homo sapiens
  misc_feature: GZ8MTXP02GNMTU.4.33.C11.1.454.CMB.2.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagngtgttatatacagcctaccaaanatgaanaactatagcttggtatcgagcaagaaaccaggacacgtacctctaagctcgctactacgtttaccggctacgccgtaacccccggggaagtccccggggtacctaggacgacgttacgttccgagggtcggtacgagggccggggtagtacggggactagtacttcactctaccactatccgacgcacgccgttcgacgacgtacgtaggtaaagtggttacggttggtaccgtttaagtttttaacgttacgttacggttaaccgaagtacccttaaaatttactttaacccgtttaaccgtttacccgttacccgggttaccgggttacccggttttacccgggggaacgggggtaaccggggtaaccgttaagggggaacggtaacggtaaccgttaaaaccggaaacggtaaacgtttcggg

SEQ ID NO: 353561 - DNA, 693 bp, Homo sapiens
  misc_feature: GZ8MTXP02I081P.4.33.C11.1.454.CMB.2.raw
  modified_base (254)..(254): a, c, t, g, unknown or other
  misc_feature (254)..(254): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggcccaccatcaactgacaagtccagccagagtgttatatacagctacaaanatgaagaactacttagcttaggtatcaagcaagaaaccaggacacgccctactaagctcgctacgtacgtttaccgggcacggtccgtacccccggggagtccccggggtcctggacgtacgtacttcgagggttcggaccgtagggccgggggttactagggggaacctagtacgtttaccaacttccgtaccaccatccgagaccagtcccgaggccgaaggtctaaggtaaagtacgtgggtacggtactttaggtttacttaacgtcggttactaacggtaacttaactttaaactttaccgttaaaaccctttccgttacccgttaccggggtttaacccgtttaccgggggaaccggggtaaacggtaaaacccgggtaaggggtacgggtaaacgtaaacggtaaccgtaaaaaccggtaaccgtttcgggg

SEQ ID NO: 353562 - DNA, 740 bp, Homo sapiens
  misc_feature: GZ8MTXP02GMZJD.4.33.C11.1.454.CMB.2.raw
  modified_base (239)..(239): a, c, t, g, unknown or other
  misc_feature (239)..(239): n is a, c, g, or t
tcagagcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtcctccagactccctggctgtgtctcgtgggcgagacgggccaccatcaactgacaagtccagccagagtgttanatacagctccaacaatgaagaactactagcttaggtatcagcaagaaaccaggacagacctactaagctagctacgtaacgtttaccgggcaacgccgtaaccccccggggaaacgtccccgggggtacccctggaacgtccgtaagtttccgaggttcgggaccgtaacgggtccgggggttcgtacgggggaaaccgtaaggttaaacgtttttccgaaccgttccttacccgaacccctaaagttccctaaaggccgtaacgtaccccggtacggaccggtacggtaccgttaacggaaagtacggttacgggtacggtaacgtttaaacgttttaacgtttacgttacggttacgaacgtaactaaaacgtttaactttacccttaaacctttaccgtaccgtttacgggttaccgtttaccggggaccgggtaacgggtaaccggtaaacgggtacgggtaaaacgtacgtaaaccgtaaaaccggtaacgtacgg

SEQ ID NO: 353563 - DNA, 648 bp, Homo sapiens
  misc_feature: GZ8MTXP02F0HB7.4.33.C11.1.454.CMB.2.raw
  modified_base (235)..(235): a, c, t, g, unknown or other
  misc_feature (235)..(235): n is a, c, g, or t
  modified_base (408)..(408): a, c, t, g, unknown or other
  misc_feature (408)..(408): n is a, c, g, or t
tcagagcactgtagcacgaccggtgctcgatttagagtgagctcgttgggtttgggggagtgtgaggggacatgagtggtagaaacagtggatatgtgtggcagtgtctgaccttggttgtttttttgttgtaggtgtccaatgtgaggtgcagctggtggagtcgtgggggagcttggtccagccagggcgtccctgagactctcctgtacagcgtctggattcaacttttcgngtatttatcgcctatggaacgttcggggtcccgccgaggcctaccgaaggggaaggggctgggaggttggggttagtttcagttagagcctagtggtcttagtgcgtagggacaaacgagaactaccgccgtcgtcgtggtaggaaacgcaagtacttcatcatctacaaagnatgacttaccgaacgctatccgactactcgtgacgagaagtacgaaacctacgaccgtaaggaaaccggaccggaacggaaccacgtacggtacccgttacttagttacgttaggtttaggttacgggtttaagttttacgttagttttgggagttagtaactttaacttacccgtaacccttagttacgtaacgtaacggtcgggaaccgtacggggtaccctggtacccgccgttccg

SEQ ID NO: 353564 - DNA, 679 bp, Homo sapiens
  misc_feature: GZ8MTXP02F1JX5.4.33.C11.1.454.CMB.2.raw
  modified_base (321)..(321): a, c, t, g, unknown or other
  misc_feature (321)..(321): n is a, c, g, or t
  modified_base (435)..(435): a, c, t, g, unknown or other
  misc_feature (435)..(435): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagcttgggttttccttgttgcttaattttaaaaggtgtaccaatgtgaggtgcagctggtggagtcgtgggggagtcttggtccagccgagggcgtccctgacgactctcctgtacagcgtctggacttctaactttcgtgatttatcgaccatcgaacgtcgggtcccnccgaggcctaccggaggggaacgggcgtgggaggttggggttagtttcaaagttggacgcctagttcggtactttagtggccgttagggaaccacgagtaaactaccggcccgngttctagggtaacggaaaagcaaggtacttacacttactaacgtcttaacgaaaggataacgtaggtaacttacccgaaacggctacgtccgtaacttagtccgtgaccaagtacgtacgaaacgacgtaccgtaaggaaaaccggaaccggaaacggaccaaacgtaccgtaccttacgtttaattaacgttggttaacggtttaacggggttaagtttttacggttaaggtttttggaaagg

SEQ ID NO: 353565 - DNA, 618 bp, Homo sapiens
  misc_feature: GZ8MTXP02HJ7S1.4.33.C11.1.454.CMB.2.raw
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (325)..(325): a, c, t, g, unknown or other
  misc_feature (325)..(325): n is a, c, g, or t
  modified_base (482)..(482): a, c, t, g, unknown or other
  misc_feature (482)..(482): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacgggccaccatcaactgcaagtccagccagatgttanatacagctacaacatgaanaactactagcttaggatcagcaagaaaccaggacacgaccctactaagctcgctctaagttcccggnacggtccgtacccccggggaacgtccccggggtcctaggacgaccgtattccgaggtcggaccgaggggtccgggtactagggggaacgtacgtactttaccaccgtacctaccaaccctatccgagacacgcccgtagacgacggtctagaaagtntgggtaggtacttagtttacgttaactggttacaagtactaaatttacttacttaactacttccgtacggtacgtttacggggacggaacggtaaccggaagggttacggataacggtacctaaaacggtacgtgg

SEQ ID NO: 353566 - DNA, 588 bp, Homo sapiens
  misc_feature: GZ8MTXP02HYIQS.4.33.C11.1.454.CMB.2.raw
  modified_base (294)..(294): a, c, t, g, unknown or other
  misc_feature (294)..(294): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
  modified_base (435)..(435): a, c, t, g, unknown or other
  misc_feature (435)..(435): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttcctgttgctattttaaaggtgtccaatgtgaggtgcagctgggtggagtcgtgggggagcgttggtccagccgagggcggtccctgagactctcctgtacagcgtctggtattcaactttcgtagatttancgaccatgaacgtgggtccgccgaggctaccgaggggagggtctgggagttgggttagtttcagttagagccagtggcttagngngtgggacacgngaaactcggccgtgtcgtgtagaacgnagatcatcatcacaaganatagtacttccgaaacggctactccgctatcgtgacgagatacgaaactacgcgtaacgacgaaccggaacgaacgaacgtacgtaccgttacttaacgttaacgttaggtttacggttagggttaagttttacgttaggtttttacggtagg

SEQ ID NO: 353567 - DNA, 782 bp, Homo sapiens
  misc_feature: GZ8MTXP02HFD2S.4.33.C11.1.454.CMB.2.raw
  modified_base (290)..(290): a, c, t, g, unknown or other
  misc_feature (290)..(290): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgtctattttaaaaggtgtccaatgtgaggtgcagcgtggtggagtcgtgggggagtcgttggtccagccgagggcggtccctgagctctcctgtacagcgtctggtacttctaactttcgngtattactcgaccagtcgaaccgtcgggtccccgccgacggccgtacccggaagggggaacggggtcggtaggggtacgggtttggggttacgttttaccgaagtttaggacgacccgtagttcgggtacctttaaggtcggtaccggtacggggaaacctaacgtaaggtaaaccgttaacccgggccccgtacgggttccgttaggggtaacggaaaacggggtacgtaaacgtacgttaccgtaacttaccgtaacgttaccgtaacgtaaagtaacgtagtacgtaaacgttacccgaaacggacctacgtaccgtccgttaactccgtacgacggaacgtaacgtacgtaaaccgaacgtacccggtaacggaaaaccggacccggaaacggaaacgaccgaccggtacccgttactttaacgttaacgtttacggttacggtttaaaggggtttacgttttaacggtttacggttttacggtaagg

SEQ ID NO: 353568 - DNA, 588 bp, Homo sapiens
  misc_feature: GZ8MTXP02JYZG4.4.33.C11.1.454.CMB.2.raw
  modified_base (138)..(138): a, c, t, g, unknown or other
  misc_feature (138)..(138): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (385)..(385): a, c, t, g, unknown or other
  misc_feature (385)..(385): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccntggagtttgggcttagcgttgggttttccttgttgcttaattttaaaggtgtaccaatgtgaggtgcagctggtggagtcgtgggggagcttggtccaggccgaggggccgtccctgacgctctcctgtacngcgtctggattcaactttcgtgattangccatgactgggccccncaggctcgagggagggctggagtggtagttcagtagngcatggntagtgcnggacagagaactcggcgctngtgaaaggcagattcatccatctacgaagagtatcgacttccgaaacggtcactcgaccttagtctgacagtacacgaacacggtaccctaggaaaacgaccggaacggaaccgtaaccgacgtcccggttaacttacgttaaccgttaggtttacggtttaggggtttaacggtttttaccggttaggtttttacgggaagg

SEQ ID NO: 353569 - DNA, 676 bp, Homo sapiens
  misc_feature: GZ8MTXP02JLADS.4.33.C11.1.454.CMB.2.raw
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggcccaccatccaactgaccaacgtccacgccagtagttagttatatacagcctacaaacatagaanaactacttagcttaggtancgaagacaaacgaaaccgaggacacgtccctacctaagctacgtcctacgtaacgtttacccgggctacggacccggtaaccccccggggaacgtccccgggggtaccctaggacgtcgtaattcggagtcggacgaggcgggtcgtagggacctagtacttaccactctaccgaacctactaccgacgactacgcccgtgaccgaggacgtagaagtcgtgggtagtacgttagtttattaccgtgtacgtaacgtactaaacttactttacctaccttaccggtacccgttaccgggttaaccggttcccgggggtaacgggaacggtaacggtaacggggtaggtaacggtaacgtaaccggtaaaacggtacgttacggg

SEQ ID NO: 353570 - DNA, 563 bp, Homo sapiens
  misc_feature: GZ8MTXP02FJO2F.4.33.C11.1.454.CMB.2.raw
tcagagcactgtagcacgaccggtgctcgatttagagtgagctcgttggggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccataaactgacaagtccagccagagttgttatatacagctaccaacaatgagaactactagcttgtatcagacaagaaaccaggacacgcctaccaagctgctcagtttaccggcagccgtaccggacgtccggggtcctgacgcgattcaggtcggcagggtcgggtcgtaggggactagtactttcgactctccaacctatacacgtcacgtccgtagcgacggctaggaacgtagtggtaggtacgttagtttagtacgtgtacgagtactaattactctactacctcgtacggtacgttcgggacggacggtaacgaaggtcgaacgacgtacgaaacgacgtaggtacgg

SEQ ID NO: 353571 - DNA, 706 bp, Homo sapiens
  misc_feature: GZ8MTXP02FVZHG.4.33.C11.1.454.CMB.2.raw
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
tcagagcactgtagcacgaccggtgctcgatttagagtgagctcgttgggtttgggggggagaggagccccagccgtgagattcccaggagtttccacttggtgatcagcactgaacacagacccaccaaccatggagtttggcttagctgggttttccttgttgcttattttaaaaggtgtccaatgtgaggtgcagctggtggagtcgtggggggagcttggtccaggccgaggggccgtccctgagacctctcctgtacngcgtctggtattctaactttcgngtattangccatgaacgtggtccncaggcctacggaggggaagggctagggagttggggttagttcagttagngccagtggtcttagcgcgtagggaacaaacgagaacgttaccggccgtacgtcgtaggtaacgaaaggtcagtacttacataccagtactagaaagtagacttacgaacttacccgaaacgtctaaacgtcccgtacttactcctggaacctaagaacgttacggaaacgtaccgtaaccggtaaacggaaaccggtacccgggaacggaaacctaccgacggtaaccccttagtttaacgttttaaccggtacgggttttacggtttaaacgggggtttaactttttaacggttaggtttttacggggaagtttagggttaactttaaacctttttaaaacccccg

SEQ ID NO: 353572 - DNA, 707 bp, Homo sapiens
  misc_feature: GZ8MTXP02FG8LT.4.33.C11.1.454.CMB.2.raw
  modified_base (277)..(277): a, c, t, g, unknown or other
  misc_feature (277)..(277): n is a, c, g, or t
  modified_base (332)..(332): a, c, t, g, unknown or other
  misc_feature (332)..(332): n is a, c, g, or t
tcagagcactgtagcacgaccggtgctcgatttagagtgagctcgttggggtttggggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatccaatgacaacgtccagccagagtgttatatacagctcaacaatgagaactactagcttggtatnagcaagaaaccaggacacgacctacctaagctgcctactaacgtttacccggggntacggtaccgtaccccccggggaacgtcccggggtacctgacgcgacttccgaggtggcgaggcggggttcgaggggactaaggtactttaccactacctccaaccataccgaacgccgacgcccgtcggcgaacgggtaccgtaggaaagtacgttcgggttcggtaaccgtttaacggttttacgtttaaacgttcgttacgtaacggtaacttaaaacgtttaacgtttaccgttaaaccttaaaccccgtttcccggttaaaccgggttacccgggtttacggggacccgggggtaacgggggtaaaacccggtaaacgggggttagggaacggtaacgtaaaccgtaaaaaccgggaccgtttaacgggg

SEQ ID NO: 353573 - DNA, 590 bp, Homo sapiens
  misc_feature: GZ8MTXP02JFKP6.4.33.C11.1.454.CMB.2.raw
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
  modified_base (305)..(305): a, c, t, g, unknown or other
  misc_feature (305)..(305): n is a, c, g, or t
tcagagcactgtagcacgaccggtgctcgatttagagtgagctcgttgggtttgggggagtgtgaggggacatgagtggtagaaacagtggatatgtgtggcagtgtctgaccttggttgtttttttgttgtaggtgtccaatgtgaggtgcagctggtggagtctgggggagcttggtccagccagggcgtccctgagactctcctgtacagcgtctggattcaacttttcgngattatgccatgaactgggtccncaggctcgagggagggctggagtggtagttcatagagcatggcttagngctgggacaacagaatacgccgtcgtctgtagaaacggcagattcatccatctacaagagatgacttccgaacgcatcgcctatctgcagatagaacacgtacagaaacgaccgacgacaacacgtccgtacttattacgtgttaggttagggttagttttacgtagtttttagggagttaggtaacttaactttaaacctaacccccgttaagtttacgtaaccgttaacggtacggggtaaccgtaacggggtaaccccttcgggtacccgtaccgtttcccg

SEQ ID NO: 353574 - DNA, 628 bp, Homo sapiens
  misc_feature: GZ8MTXP02FHHAK.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgacaagtccagccagagtgttatatacagctccaaacaatgaagtaactacttagcttggtatcagacaagaaacaggacagcctactaagctgctacgtagtttaccggggcacggtaccgtaaccccccggggaacgttccccggggtacctggacgccgattccgaggtggcaggcggggtctcgggacagtatttcactctacacatcagacagcctcgacgaggacgtagaagtattggtgtacttaggtttaattacgtagtacacgtactaattaacttacctacttacccgttaccgttaccggggttaaccgttttaccgggggaccggggtaaacgggggtaacccggaaacggggttaacggggaaagtacgttaaaccgaaaaacggtaccggttaacgggg

SEQ ID NO: 353575 - DNA, 609 bp, Homo sapiens
  misc_feature: GZ8MTXP02GEPUL.4.33.C11.1.454.CMB.2.raw
  modified_base (315)..(315): a, c, t, g, unknown or other
  misc_feature (315)..(315): n is a, c, g, or t
  modified_base (386)..(386): a, c, t, g, unknown or other
  misc_feature (386)..(386): n is a, c, g, or t
  modified_base (514)..(514): a, c, t, g, unknown or other
  misc_feature (514)..(514): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccgagggcggtccctgagactctcctgtacagcgtctggattcaactttcgtgtatttatgccagtgaactcggggtcccnccgaggcctaccggagggggaaggggctgggaggttggggtaggtttcaagttagagcctagtggctttangctaggggaacacgaagaaactccgccgtcgtctggtagaaagcagtattcatcatctacgaagagatgtaacttacccgaaacggtctaactccggtaccttatccgtagacgagtactagaaaccngacccgtaagaaacggaccggaggaaccacgacgtcccgtattaacgttaacgttggttacggtttagggtagttttacggtagttttaggtaag

SEQ ID NO: 353576 - DNA, 625 bp, Homo sapiens
  misc_feature: GZ8MTXP02FNXYZ.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttaattttaaaaggtgtccaatgtgaggtgcagcgtggtggagtcgtgggggagcttggtccagccgagggccggtccctgacgactctcctgtacagcgtctggacttcaactttcgtgatttatgccatgaacgtgggtcccgccaggcctccgaggggaaggggctgggaggtgggtagtttcattagagccagtggcttatgctagggaacacgagaaactaccgccgcttgtagtaggaaaacggcaagtacttacatctatactacaaagagtatagtaacttaccgaacggctactccgtcctaatcgtgacagtactacgaaacacgaccgtaacggaaaccggaaccggacgggaaccaacgtacgacccgttacttaacgttaaccgttggttacgggtttaaggggtttaacgttttacggtttaggtttttagggtaagg

SEQ ID NO: 353577 - DNA, 672 bp, Homo sapiens
  misc_feature: GZ8MTXP02FXLDS.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaaggtgtccaatgtgaggtgcagctgggtggagtcgtgggggagcttggtccagccgaggggccggtccctgacgactctcctgtaccagcgtctggtattctaacttttcgagtatttatgaccagtacgaacgtcgggtcccgccgaggcctaccggaaggggaaggggcgtggggaggttggggttagtttcaagttaggacgtcctagtgggtctttagtcggtcgtacggggaacctaacgagtaaactaccggaccgcgttacgtagggtacgaaaagggccaagtattacattacactcctaagaaagtataagtgtaaacttaccgaaacggtcaacgtccggtacctaacttccgagacgaagtatacgaaacgacgacgtacgaaacggaccggaacggtaccaacgaccgtacccgttattaacgttaacgttaggttagggttttacgggttaagtttttacggtaggtttttaggtaagg

SEQ ID NO: 353578 - DNA, 628 bp, Homo sapiens
  misc_feature: GZ8MTXP02GE129.4.33.C11.1.454.CMB.2.raw
  modified_base (334)..(334): a, c, t, g, unknown or other
  misc_feature (334)..(334): n is a, c, g, or t
tcagagcactgtagcacgaccggtgctcgatttagagtgagctcgttggggttggggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagtagtgttatatacagcctaccaaacaatgaagtaaccttactagtcttaggtatcagacaagaaaccaggacagcctacaagctgctacgtagttaccggntacgccgtaacccccgggtaacgtccggggtcctaggacgtacgattccgaggtcggacgacggggtccggggtacgttagggggaactacggttactttcccgtaactcctaccaacccagtaccagacctaacgcctcgacggacgtacgtaggtaaagtggttcggtaggttacttaggttttaactcgttaggtactagtactaattactacgttacctcgtaccgtacggttacgtcgggaacgggtacggaacggtaaggtagacgacgtaacgaaacggtacgtcgg

SEQ ID NO: 353579 - DNA, 824 bp, Homo sapiens
  misc_feature: GZ8MTXP02JHUT4.4.33.C11.1.454.CMB.2.raw
  modified_base (261)..(261): a, c, t, g, unknown or other
  misc_feature (261)..(261): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttggcttagctgggttttccttgttgctattttaaaaggtgtccaatgtgaggtgcagctggtggagtcgtgggggagcttggtccagccagggccgtccctgagactctcctgtacagcgtntggattctaactttcgtagtacttatcgaccagtacggaaaccgtcggggtccccgaccgaagggtcccgttacccggaaagggggggtaaacggggccgttaggggtagggtttcgggggtttaaggttttaccgtaagtttttagggaccgtcccgtaagttcggggtaccttttaaggtcggtaccgttacgggggaaacctaaaacgaacggtaaaaccgttaacccgggcccggggttcgttaccgttaaggggttaacgggaaaacgggggtacctaaagggtaaacgtttacccgtaacgttaacccgtaattaccgtttaaaccgaaaacggtaaaggtaacgtttacggtaaaccgtttacccgaaaaccggggtcctaaacggttcccggtaacctttaacgtcgttacggactaacggactaacggaaacgacgacgtaacggaaacgaccgaacggaacacgacgtacccttagtacctttagtacggttaggttaacggttaacgtttaggttacgttttaggagttaggtaacttacgtttaaaccccg

SEQ ID NO: 353580 - DNA, 612 bp, Homo sapiens
  misc_feature: GZ8MTXP02FT413.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgctattttaaaaggtgtccaatgtgaggtgcagctggtggagtcgtgggggagcttggtccagccgagggccgtccctgagactctcctgtacagcgtctggattcaactttcgtgtatttatgccagtgaacgtgggtcccgccgaggcctccgaggggaagggcgtgggaggtgggtaggtttcagttagagccagtggcttatgcgtagggaacacgagaaactccggacccgcgtcgtagtagaaagcagattcatcatctacgaagagatgaacttacccgaaacggtcacgtccgtacccttaatccgtaggacagtaatacgaaacgacgaccgtaaggaaacgaaccggacggaaaccaccgacgtacccgttattaacgttcgttaggttacggtttagggttaggtttttaacgtagtttttagggtaagg

SEQ ID NO: 353581 - DNA, 663 bp, Homo sapiens
  misc_feature: GZ8MTXP02FKHA4.4.33.C11.1.454.CMB.2.raw
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggcttggtccagccgagggcgtccctgagctctcctgtacagcgtctggattctaatttcgtgtattangccatgaacgtggtccncgaggctcgagggaggctggagtggggtagtttcagttagacgtccagtggtcttatggcgtaggggacaacgagtaaactacggcccgcgttacgtaggtaacggaaaacgggcgtaaacggtacgtttaccaagtttcccaaacgttcctaaaccgtaaaaggaacgtatacggtaaactttacccgaaaccgggtacctaacgtcccgtaacccttatccgttcggaacaggtagtaacggaaacacgtcccgaacgaaacggaccggaaacggaaccaccgacgacccgtacttaacgttaacgtagtttacgggttagggttacgttttacggtagttttaggtaacgg

SEQ ID NO: 353582 - DNA, 661 bp, Homo sapiens
  misc_feature: GZ8MTXP02F4IKM.4.33.C11.1.454.CMB.2.raw
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (312)..(312): a, c, t, g, unknown or other
  misc_feature (312)..(312): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaggtgtccaatgtgaggtgcagctggtggagtcgtgggggagcgttggtccagccgagggcggtccctgacgactctcctgtacngcgtctggattcaactttcgngattatgccatcgaacgtggggtcccnccgaggcctccgaggggaaggggctgggagttggggtaggtttcaagttaggagcctagtgggtctttagtggcgttaggggaacaacgagaaacttaccggcccgtcgttctgggtacgaaaggcaagtattacgatcaatcctaacaagagatggtaacttacccgaaacggactacgtaccgaccttatccctagaccgagtaacgagaaccgaggtaccctaagggaaccgaaccggaaacggaaccgaaaccgtaccggtacccgttacttaacgtttaacgttcgggtttaacggtttacgggggttaacgttttttaacggtaggttttttacggtaaaggg

SEQ ID NO: 353583 - DNA, 565 bp, Homo sapiens
  misc_feature: GZ8MTXP02IO8J9.4.33.C11.1.454.CMB.2.raw
  modified_base (261)..(261): a, c, t, g, unknown or other
  misc_feature (261)..(261): n is a, c, g, or t
  modified_base (416)..(416): a, c, t, g, unknown or other
  misc_feature (416)..(416): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacgggccaccatcaactgacaagtccagcagtagtgttatatacagcctacaacaatgaanaactacttagcttaggatcaagacaacgaaaccgaggacagccctactaagctgctcacgttaccggcacgtccgtacccccgggagtccccgggtctagacgcgtatcgagtcggcgagtccgggtcgagggacagtcttcactctacgactancagcagcctgaccgagtcgtagaagtgtagtacggtacttagtttattcgtagtactaagtactaatttactacttaactccgttacgtacggtacgttcgggacgtaacgggaacgtaaggacgtacgtactaacgaaacggtatcgg

SEQ ID NO: 353584 - DNA, 633 bp, Homo sapiens
  misc_feature: GZ8MTXP02I6VMI.4.33.C11.1.454.CMB.2.raw
tcagagcactgtagcacgaccggtgctcgatttagagtgagctcgttgggtttggggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagtgttatatacagcctacaaacatgaagaactacttagtcttggatcagacaagaaaccaggacacgaccctacgtaagctcgtcctactaaccgttaccgggacacggtacccggtaacccccggggaccgttccccggggtccctacggacgtacgtacttcgaggtcggccgacggtccggggtacgagggtaacctaagtatttccacgttcacacctatcacgccacgccgtgacgtaggtactaggaagtcgtgggtagtacgttagtttactactgtacagacttaattacttacttaacctacgttcccggtacggttaccggttacgggacgggtaaacgggtaacggtaacggggtaggaacgtaacgtaaccgaaaacggtacgttagg

SEQ ID NO: 353585 - DNA, 732 bp, Homo sapiens
  misc_feature: GZ8MTXP02FS5Y6.4.33.C11.1.454.CMB.2.raw
  modified_base (312)..(312): a, c, t, g, unknown or other
  misc_feature (312)..(312): n is a, c, g, or t
  modified_base (486)..(486): a, c, t, g, unknown or other
  misc_feature (486)..(486): n is a, c, g, or t
tcagagcactgtagcacgaccggtgctcgatttagagtgagctcgttggggtttgggggggagaggagccccagccgtgagattcccaggagtttccacttggtgatcagcactgaacacagaccaccaaccatggagtttggcttagctgggttttccttgttgctatttaaaggtgtccaatgtgaggtgcagctggtggagtcgtgggggagcttggtccagccgagggccgtccctgagactctcctgtacagcgtctggtattctaacttttcgtgtatttatgcctagtcgaacgtcggggtcccnccgaggcctaccggagggggaacgggtcgtagggtaggttggggtttaggtttcgaagttacggacgtcctagtggtactttagtccggcgttagggaactaaacgagtaaacgtaccggccgcgttcgtagggtaggaaaacgtctaaagtacttacacttactaatacctanaaaggaactagttagtaaccttaccgaaaccggtctaactcccgtaaccttgtaccctagaccgaagtacttaacggaaccgtacgacccgtaacgggaaaaccggaccggaaaacggacccaacggtaccggtaccccgtttaaacttaaggtttaccgttagggtttacgggtttaaaggggttaacgtttttacggttaggtttttagggaacggtttaggtaactttaacgttttaaacccc

SEQ ID NO: 353586 - DNA, 591 bp, Homo sapiens
  misc_feature: GZ8MTXP02FPHEX.4.33.C11.1.454.CMB.2.raw
  modified_base (173)..(173): a, c, t, g, unknown or other
  misc_feature (173)..(173): n is a, c, g, or t
  modified_base (250)..(250): a, c, t, g, unknown or other
  misc_feature (250)..(250): n is a, c, g, or t
  modified_base (300)..(300): a, c, t, g, unknown or other
  misc_feature (300)..(300): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (430)..(430): a, c, t, g, unknown or other
  misc_feature (430)..(430): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagttggcttagctgggtttcctgttgctattttaaagngtccaatgtgaggtgcagctggtggagtcgtgggggagcttggtccagccagggcggtcctgagactctcctgtacngcgtctggattcaacttttcgtagattatgcccatgaactggggtacccnccaggcctccgaggggaagggtcgtggagtggggtaggtttcagttagngcatggcttangctagggacaacgagtaactacggccgagtctggtacgaaaagggcagtattcgatacatctacaagtanatgattccaaaccgcaaattccgacctatctcgananagtgaacgcgaccgagaaagacccgaggaactacgacggtacctacttaattaccgttaggttacggtttaggtaagtttttacggtagtttttacggggattaggtactttatttaaaccccg

SEQ ID NO: 353587 - DNA, 630 bp, Homo sapiens
  misc_feature: GZ8MTXP02FTWZ0.4.33.C11.1.454.CMB.2.raw
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
  modified_base (388)..(388): a, c, t, g, unknown or other
  misc_feature (388)..(388): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggaggtcgttgggtcccggccgaggggccggtccctgagacctctcctgtacagtcgtctggtattcaactttcgngtattancgccatcggaacgtgggtccncgaggcctccggaggggagggctgggaggtgggtagtttcagttagagcctagtcggtcttagngcgtagggaactaacgagaactaccggccgtcgttcgtaggtaggaaaacggcagtacttcatcatctacaaagagtatacgtacttaccgaacggtcacgtccgtacctatcgtacgacgtaagagtacgaaacacgaccgtaggaaacggaccgaaggaccaaacgcgtacccgttattacgtttacgaaggtttaggttaaggggtttacttttaaggttagttttagggacgtttaag

SEQ ID NO: 353588 - DNA, 656 bp, Homo sapiens
  misc_feature: GZ8MTXP02JF2VV.4.33.C11.1.454.CMB.2.raw
  modified_base (370)..(370): a, c, t, g, unknown or other
  misc_feature (370)..(370): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaagtccagccagagtgttatatacagctacaacatgacgaactacttagcttggtatcagacaacgaaaccaggacacgccctactaagctcgtctacgtacgtttcccgggcacggaccgtaccccccggggaacgtccccggggtcccnggacgcgtattccgaggtcggacgtagggcgggtcgtaggggaccagtctttaccaccttcaccaccctaatccgacgtccaggccctaggcccgaagggtacctagggaaacggtagttacggggtacggtacttaagggttttacttaccggttgttaaccgagtaaccttaaagtttactttaccctaaccttaacccgtccgttaacgggttaccgtttaccgggaacgggtacgggtaacggaagggttacggacgtaactacgaaaaccgttacgtacgg

SEQ ID NO: 353589 - DNA, 654 bp, Homo sapiens
  misc_feature: GZ8MTXP02GU6VN.4.33.C11.1.454.CMB.2.raw
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacgggccaccatcaactgacaagtccagccagagtagttatatacagctaccaanatgaataactatagnttgtatcagacaagaaaccgagacacgtccctacgtaagcctgacctacgtacgttaccggggcacggtacccgtaacccccggggtaaccgtccccggggtcccagggacgtacgtacttcggacggtggccgacggggtccggggtagtacggggactagtacgtttccacgtacctacaacctactccgacgacacgcctaggaccgtaggcgtaaggagtagtggtacgtacgttagtttaatcgtaggtcaaggtaacttaaactttaacttaccttaaaccgtccgttacccggttacggttaccggttaccggggacggtaaacgggaaccgtacggggtaagaaacgtacgtaaacggtaaaccgtagttcgggg

SEQ ID NO: 353590 - DNA, 621 bp, Homo sapiens
  misc_feature: GZ8MTXP02JGKS7.4.33.C11.1.454.CMB.2.raw
  modified_base (268)..(268): a, c, t, g, unknown or other
  misc_feature (268)..(268): n is a, c, g, or t
  modified_base (332)..(332): a, c, t, g, unknown or other
  misc_feature (332)..(332): n is a, c, g, or t
  modified_base (410)..(410): a, c, t, g, unknown or other
  misc_feature (410)..(410): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctcccgtggctgtgtctcgtgggcgaggacgggccaccgatccaactgacaagtccagccagagttgttatataccagcctacaaacaatgaanaactactagcttggtatcagacaaagaaacaggacagtcccactaagctgctctagttaccggnacggctaacccccggggaacgtcccggggtcctaggcgctacgttcgaggtcggccaggggcgggttacgtggggaanagtacttccactctaccacctatccgaacgccgaagtcccgaggaccgacggacgttaaggagtagttcgggtaggtaacttaaggttttactacgtagtaccgtaagtaacttaattacttaccgttacttaccgttccgtaaccgtcgtttaccggacgggtaaacggaacggacgggttagacggtaacaacggtaaaccgtacgtag

SEQ ID NO: 353591 - DNA, 786 bp, Homo sapiens
  misc_feature: GZ8MTXP02HK6ZA.4.33.C11.1.454.CMB.2.raw
  modified_base (483)..(483): a, c, t, g, unknown or other
  misc_feature (483)..(483): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttattttaaaggtgtccaatgtgaggtgcagcgtggtggagtcggtgggggaggtcgttggtccaggccgaggggccggtccctggacgtacctctcctgtacagtcgtctggattactaactttcgtgtattatcgcctagtcgaacgttcgggtcccacgacggtacctaccggaaggggaaggggtcgtaggggacggttggggttagtttcgaagttagacgtcagtggtacttagtcgacgtagggaacacgagaacgtaccgccgtcgtacgtaggtagaaaggcagtactcatcataccgtanaaacgtatagtacgtacttacccgaacggtactacgtacccgacccttaagttccgacgtaccgaaagttacgtaaacggtaacccgaaacgggttacccgtaaaacggggaaaaccggaaccccggggaaacgggtaaaacccggaaacccgtaacccgggggttaccccttttaaaccgtttaaaaaccgggttttcccgtttaagggggtttttaaaccgggggtttttaaaagggggttttaaaccgggtttttttaaacgggttttaacggggtttttttaaccggtttaaaaggggg

SEQ ID NO: 353592 - DNA, 685 bp, Homo sapiens
  misc_feature: GZ8MTXP02JGK85.4.33.C11.1.454.CMB.2.raw
  modified_base (386)..(386): a, c, t, g, unknown or other
  misc_feature (386)..(386): n is a, c, g, or t
  modified_base (461)..(461): a, c, t, g, unknown or other
  misc_feature (461)..(461): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgtgctattttaaaggtgtccaatgtgaggtgcagctggtggagtcgtgggggaggcttggtccagccgagggcggtccctgacgactctcctgtacagcgtctggattctaactttcgtgtatttatgccatcgaacgttcgggcccgccaggcctccggaggggaaggggctggggaggttggggtaggtttcaagttagacgtccagtggtacttangacgtgggaacacgagaataccgccgtacgtctagtaggaaaaggcaagtacttcaattcgaatcgtacaaaggngtatacgtaaacttacccgaaacgggtcctaaacgtcccgaccctttaagtccgtacggactaggtaatcgggaaaaccctaggccccgtaaaagggaaaacccggaaccgggaaaccgggaccaaccggtaccggtcccccggttatttaaacgtttaaccgtgggtttaaggggtttaacggggtttatttttaaccggggtttaacgttttggggtaaacg

SEQ ID NO: 353593 - DNA, 642 bp, Homo sapiens
  misc_feature: GZ8MTXP02GFRU4.4.33.C11.1.454.CMB.2.raw
  modified_base (338)..(338): a, c, t, g, unknown or other
  misc_feature (338)..(338): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtggcgagacgggccacatcaactgacaacgtccagccagtagtgttaatatacagcctaccaaactaatgaataacttactagtcgttgtactcagccaaagaaaccaggacacgccctactaagctgctacgtacgttccgganacgtaccgtacccccgggtacgtcccggggtacctaggacgcgttatcgaggtcggacgaggggtccgggttacgtacgggaactaacgttacttacccgacctacctaaccaaccctacgtacgaacggtccaccgtccgtacgacggtacggacgtaagtagtacgtgggtacgtacgttagtttactagtcgtagacgtacttaacttactacttaccgttacctaccggtacggttaccggttcgggacggtaacggaaccggtaacgggtagtacgtaacgtaacgaaacgtcgtacgg

SEQ ID NO: 353594 - DNA, 576 bp, Homo sapiens
  misc_feature: GZ8MTXP02FF60H.4.33.C11.1.454.CMB.2.raw
  modified_base (184)..(184): a, c, t, g, unknown or other
  misc_feature (184)..(184): n is a, c, g, or t
  modified_base (308)..(308): a, c, t, g, unknown or other
  misc_feature (308)..(308): n is a, c, g, or t
  modified_base (369)..(369): a, c, t, g, unknown or other
  misc_feature (369)..(369): n is a, c, g, or t
  modified_base (395)..(395): a, c, t, g, unknown or other
  misc_feature (395)..(395): n is a, c, g, or t
  modified_base (431)..(431): a, c, t, g, unknown or other
  misc_feature (431)..(431): n is a, c, g, or t
  modified_base (483)..(483): a, c, t, g, unknown or other
  misc_feature (483)..(483): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctatttaaaaggngtccaatgtgaggtgcagctggtggagtcgtgggggagcttggtccagccgagggcgtccctgagactctcctgtacagcgtctggattcaactttcgtgattatgccagtgaactggggtccnccgaggcctccgaggggaggggtctgggagtgggtaggtttcattagagccatggcttagngctgggaacacgagaaactacgccgngtctggtagaaaggcagtattcatcatctacaaagngatcgaacttccgaaacggcaatccgacctatcctagcaagactagaaaccncgtacgacgaacgaccggaacgaacacgacgtaccgtacttaacgttaacgtaggttacggttacggttagttttaacggtagttttaggacg

SEQ ID NO: 353595 - DNA, 631 bp, Homo sapiens
  misc_feature: GZ8MTXP02H6ADT.4.33.C11.1.454.CMB.2.raw
  modified_base (268)..(268): a, c, t, g, unknown or other
  misc_feature (268)..(268): n is a, c, g, or t
  modified_base (318)..(318): a, c, t, g, unknown or other
  misc_feature (318)..(318): n is a, c, g, or t
  modified_base (471)..(471): a, c, t, g, unknown or other
  misc_feature (471)..(471): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtgggggagtcttggtccagccgagggccggtccctgacgactctcctgtacngcgtctggattcaactttcgagtattatgccagtgaaccgtcgggtcccnccgaggcctaccggaggggaaggggtcgtaggggagggttggggttaggtttcaagtttagacgtccagttggctttagtcgacgtacgggaaccaagacgaaacgtaccggcccgtcggtctggtaggaaaggcagtattcatacatcctanaagagatgacttacccgaacggcctagtcccgccttagtccgtgactagactacgaacgacgaccctagaaacgaccggaacggaaccacgacggccctttacttaattaacgttaggttaagtttacggggttaattttacggttagttttgggtaagg

SEQ ID NO: 353596 - DNA, 698 bp, Homo sapiens
  misc_feature: GZ8MTXP02JF6DO.4.33.C11.1.454.CMB.2.raw
  modified_base (284)..(284): a, c, t, g, unknown or other
  misc_feature (284)..(284): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgcttaattttaaaaggtgtccaatgtgaggtgcagctgggtggagtcgtggggggagcttggtccagccgagggccggtccctgagactctcctgtacagcgtctggattcaactttcgngtattatgccatcgaacgtcgggtcccgccgaggcctccgaaggggaacggggctgggaggttgggttaggtttcaagtttaggagtccagttcggactttagcgtcgtagggaaccaaagagtaaactaccgccgtacgttcgtaggtacgaaaaggctaaggtactttacattcccgaatcctacgaaaagagtaattacggtaaccttacccgaaaaccgggtcaaacgttacccgacctttaacgtctggacctaagggacttacgaaaccgacggtaccgtacggaaaacggacccggaagggtaaccaccgacggtacccgttacttaagtttacgtcgggttaaggtttaaggggttaacgttttaacgtttgttttagggagttacggtatttaactttaaacccg

SEQ ID NO: 353597 - DNA, 795 bp, Homo sapiens
  misc_feature: GZ8MTXP02HGJAO.4.33.C11.1.454.CMB.2.raw
  modified_base (266)..(266): a, c, t, g, unknown or other
  misc_feature (266)..(266): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtcctccagacctcccgtggctgtgtctcgtgggcgaggacgggccaccataccaactgacaagtccagccagtagttgttatactacagacctaccaaanaagtgaaacgtaaaccttacgttagcgtttaggtactcgaagaccaaacggaaaaccgtaggaaccaccgtccctaaccgtaagcctacgtaccttactaccggtttaacccggggctaaccgggtacccggtaaccccccggggtaacggttcccccgggggtaccctagggacggaccgttaacgttccggagggttcgggaccggtacgggggtccgggggtacgtacgggggtaaacctacggttacctttacccgaccttacccgtacctaaacccgtactaccgaacggaccctaaccgggcccgttggaaccggtagggtaccgtaaagggtaacggtagttggggtacgttaccgtttaaggtttactaccgttaggtaaccgtaagtaaccttaatttaccgttacctaacctttaacccgtccgggttaaccggttaccgggttaccggggaaccgggtaaacggtaacggtaacgggttaggaaaacttaaccgaaaccggtaaaacggtacgtcggg

SEQ ID NO: 353598 - DNA, 714 bp, Homo sapiens
  misc_feature: GZ8MTXP02I8DBV.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggcccaccatcaacgtgaccaagtccagccagagtgttatatacagcctaccaaactaatgaagtaactacttagctttggatcaagcaagaaaccaggacacgtcctactaagctgctactagtttaccgggctaggtccgtaacccccggggtattccccgggggtccctaggtacgtccgtaacgtttcgaacggttcgggctaagggtccggggttcgtaggggtacctaggtacttttaccgaccgttcctaccgaacccgttagtacccgtaagcccgtaacgtcccgtaggtacccggtaacggtaccgtaacggtaaacgttacggttacgggttacggtaccgtttaaggtttttaacgttaccgttacggttaccaacgggttactaaacgtttacgtttacccgttaaacgttacccgttaccggtacggttaccgtttaccgggacggtaacggtaaccgtagggtacgtacgtacgtaacgaaaccggtacgttacgg

SEQ ID NO: 353599 - DNA, 587 bp, Homo sapiens
  misc_feature: GZ8MTXP02FFVRC.4.33.C11.1.454.CMB.2.raw
  modified_base (326)..(326): a, c, t, g, unknown or other
  misc_feature (326)..(326): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgaggagggccaccatcaatgacaagtccagccagagtgttatatacagctccaacaatgaagaactactagcttaggtatcagcaagaaaccgaggacagcctacctaagctgctctacgtttaccgggnacggtccgtaaccccccggggaagtcccggggtcctggacgcgtattcgagtcggacgaggcgggtcgtgggacagtatttccacttctacaccatcagacacgacctgacaggctagaagagtggtgtacctaagtttacttacgtcgtacgagtactaaattacttaccttaacttaccgtcccgttacggtaccgtttacgggacgggaacgggaaccgtaaagggtacggaagactaaacgaaaacgtacgtacggg

SEQ ID NO: 353600 - DNA, 822 bp, Homo sapiens
  misc_feature: GZ8MTXP02IRDUU.4.33.C11.1.454.CMB.2.raw
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagcttgggttttccttgttgcttaattttaaaaggtgtccaatgtgaggtgcagctggtggagtcgtgggggagcgttggtccagccgagggccgtccctgacgactctcctgtacagcgtctggtacttctaactttcgtgtattatgcctagtgtaacgtcgggtcccgccgaggcctaccggaggggaacggggcgtaggggaggttggggttaaggtttacagtttacggacgtcccgaagttcggtactttagtccggtcggtaagggaacctaaaacgaagtaaaccgtaccggtcccggtcgttaccggtaggttaaggaaaacggggtcaagttaacttactaacttacctaacttccgtaacgaaaggtagtaagttacggtaacccgttaacccggaaccgggtacctacggttaccccgtaccctttaacggttcccttagggtacctaagaacccgtaagaaacccgaacgttaccccggtaaaggaaaacccgaaccgggaaaccgggtaaccaacccggtaccgtacccccgttagtttaaccgtttaaccggtttcggtttaaacggggttttacgggttttaaggtttttacgggttttaagggttttttacgggtaaggtttacggtttaaaacttttaccgtttttaaaaaccccccg

SEQ ID NO: 353601 - DNA, 555 bp, Homo sapiens
  misc_feature: GZ8MTXP02I1OW1.4.33.C11.1.454.CMB.2.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtggggcgagacgggccaccatcaactgacaagtccagccagagtgttanatacagctcaacaatgaanaactactagcttaggatcagcaagaaaccaggacagcctactaagctgctctacgttaccgggcagccgtacccccgggatcccggggtcctggacgcgattcgagtggcagcgggtctgggactagattcactctacacatcagcagcctgacaggctaggaagtacgtggtacgactagtttactactgtcagtactaattacttactaccttacgtccgttacggtacgttcggggacggtaacgggaaccgtaaagggttaggaacgtagtaaccgaaacggtaacgttcgg

SEQ ID NO: 353602 - DNA, 752 bp, Homo sapiens
  misc_feature: GZ8MTXP02F92L0.4.33.C11.1.454.CMB.2.raw
  modified_base (321)..(321): a, c, t, g, unknown or other
  misc_feature (321)..(321): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcgtccctgacgactctctgtacagcgtctggattctaactttcgtgtattatcgacctatacggaacgttcggggtccccnccgagggccctaccggaagggggaacggggtctaggggtacgggttggggttaacgggttttcaaagtttaggacgtcctaaggttcgggtactttaagtcggtaccgttaacggggaaacctaaacggacgtaaacgttaaccggcccccggtagtttcgtagggtagggaaaaaccgggtgtaaacgttacttacgaacttaccgtaacttacccgtaaagaaaaggtagtaaacgttacgtaaccgttaacccgaaccggtacctaccgttacccgtaccttacgtaccgtacgacgaagtaaacaacggaaaccgacgtaaccgtaacggaaacggaccgaacggaaccaccgtacgtaccttattaacgttaacggttaggttaagggtttaacgggtttagttttaacggttaggttttaggtag

SEQ ID NO: 353603 - DNA, 653 bp, Homo sapiens
  misc_feature: GZ8MTXP02JC3W0.4.33.C11.1.454.CMB.2.raw
  modified_base (314)..(314): a, c, t, g, unknown or other
  misc_feature (314)..(314): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaaggtgtccaatgtgaggtgcagctggtggagtcgtgggggaggcttggtccagccgagggcggtccctgagactctcctgtacagcgtctggattcaactttcgtgatttatgccaatcgaacgtggggtcccnccgaggcctccgaggggaagggcgtgggaggttgggtaggtttcagttagagtccagtcggctttagcggctaggggacacgtagaacgttaccgcccggtcgtacgtggtaacggaaaacgggtcaacggtatttacagttacctactacccttaagaaaacggtagaacgttcggtaaacgtttaaccccgaaacggggtaccctaacgtacccggtaccttaacgtcttacgacgagtatacgaacgacgaccgtacggaacgacgacggacaacgcgtaccgtacttagtaacgtggtagtttaacgggtagttttaacgtgttttacggtaagg

SEQ ID NO: 353604 - DNA, 650 bp, Homo sapiens
  misc_feature: GZ8MTXP02H5N83.4.33.C11.1.454.CMB.2.raw
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggccaccatcaactgacaagtccagccagagttgttatatacagcctaccaaacaatgaagtaactacttagcttggtatcagcaagaaaccaggacacgccctacaagctgctcgtacgttaccgggcacggccgtacccccggggacgtcccggggtccctggacgtcgattcgaggtcggaccgtaggccggggtcgtggggaactagtatttcccacttcctaccaccctataccgaacgccgtacgcctcggaccgtacggccgtaaggagtacgttgggtacggtacgtttagttttacttacgttgtactaagtactaactttacttaccttaccttaccgttaccgttaccgggttaccggttacggggaccgggaacgggggtaaccgtaaagggggtacggtaacgtaacgtaaccgaaaacggtacggttacgg

SEQ ID NO: 353605 - DNA, 582 bp, Homo sapiens
  misc_feature: GZ8MTXP02IDNFM.4.33.C11.1.454.CMB.2.raw
  modified_base (260)..(260): a, c, t, g, unknown or other
  misc_feature (260)..(260): n is a, c, g, or t
  modified_base (386)..(386): a, c, t, g, unknown or other
  misc_feature (386)..(386): n is a, c, g, or t
  modified_base (438)..(438): a, c, t, g, unknown or other
  misc_feature (438)..(438): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgttatcgacccagtctccagacctccctggctgtgtctcgtgggcgaggacgggccaccatcaactgacaagtccagccagtagtgttaatatacagctaccaaanaatgaagtaactacttagcttaggtactcaagacaacgaaaccaggacacgccctacaagctcgctacgagttacccggacacgacccgtaccgggaccgtcccggggtcctggacgcgtattcgnggtcgcgacgggcggtcgtgggactagtacttcacttcaccacactacgacncgacgtccgagcgagtcgtagaagtagtaggtcgtacttagtttacttacgtgtacatactattacttactaactcctacgtacgtacgttcgggacggtaaggaccgtaaggacgaacgtacgtacgaacgtacgtcggtacg

SEQ ID NO: 353606 - DNA, 590 bp, Homo sapiens
  misc_feature: GZ8MTXP02FFPLS.4.33.C11.1.454.CMB.2.raw
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (390)..(390): a, c, t, g, unknown or other
  misc_feature (390)..(390): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgcttaattttaaaaggtgtccaatgtgaggtgcagctggtggagtcgtgggggagtcttggccagccgagggcgtcctgagactctcctgacngcgtctggattcaactttcgngtattangcctatgaactgggtccncaggctcgaggggaggctggagtgggtaggtttcagtagacgcagtggtctagtgcgtagggaacacagaaactacgcccgngttctgtagaaaagcagattcatcatctanaagngatagacttacccgaaaggctagtccgtaccctaatccgtagacgaagtatacgaaaccgtacgacccgtaaggaaacgacccgggaagaaccctacgacgtacccgtcttaacgttgttaggttaggtttagggttacgttttaacggtagtttttagggtaagg

SEQ ID NO: 353607 - DNA, 725 bp, Homo sapiens
  misc_feature: GZ8MTXP02HH94N.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagcttgggttttccttgttgcttaattttaaaaggtgtaccaatgtgaggtgcagcgtgggtggaggtcgtgggggagtcgttggtccaggccgaggggccggttccctggacgtacctctccgtgtacagtcgtcgtggtacttcgtaacttttcgagatttagtcgacctagtcgaacggtcgggtccccgcgacggtcctaccggaagggggtacggggtctaggggtacgggtttggggttaacgtttcgaagtttaaggcggacctaagttcgggtactttagcggtcgtaaggggaaccaacggtacgaaacgttcccgcccgtagtacgttgggaagggaaacgcaagtactctatacctattacacgaaagagtatacggtacttaccgaacggtctaaccgtccgtcctaagttcgacgacgtaggaacttacgaacgacgaccgtaacggaaaaccgaccggaaacgtacccgaaacggccgtaccgttaaaccttacgttaacggttggttaaacggggtttacgggttaaacggtttttacgtagggtttttaaacggggtg

SEQ ID NO: 353608 - DNA, 607 bp, Homo sapiens
  misc_feature: GZ8MTXP02FZOO1.4.33.C11.1.454.CMB.2.raw
  modified_base (334)..(334): a, c, t, g, unknown or other
  misc_feature (334)..(334): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgccgtacggggacatcgtgatgacccagtctccagacctcccgtggctgtgtctcgtgggcgaggacgggccaaccatcaactgacaacgtccagaccagtagttagttatatacagcctaccaaacaatgaagtaaactacgttagcgttggtactcgagacaaacgaaaccgagaccacgtccctactaagctanctctacgttccgggctacgccgtaaccccggacgtcccgggcctgacgcgtatcgaggcgcgcggcggtcngggactgtnttcgactctacactnacgngacagcctagcgagactaggaagtggtcggtacgtactttaaggtttacttacgtacggtacaagttactaaacgttcttaccgttaacctccggttccgttacgttaccggttcgggaacgggacgggtaacgtaacggggtgtaaacgacgtaaacggaaactacgttacgg

SEQ ID NO: 353609 - DNA, 664 bp, Homo sapiens
  misc_feature: GZ8MTXP02I1166.4.33.C11.1.454.CMB.2.raw
  modified_base (285)..(285): a, c, t, g, unknown or other
  misc_feature (285)..(285): n is a, c, g, or t
  modified_base (495)..(495): a, c, t, g, unknown or other
  misc_feature (495)..(495): n is a, c, g, or t
  modified_base (535)..(535): a, c, t, g, unknown or other
  misc_feature (535)..(535): n is a, c, g, or t
tcagagcactgtagcacgaccggtgctcgatttagagtgagctcgttgggtttggtggggagaggagccccagccgtgagattcccaggagtttccacttggtgatcagcactgaacacagaccaccaaccatggagtttgggcttagcttgggttttccttgttgcttaattttaaaaggtgtccaatgtgaggtgcagcgtggtggagtcgtgggggaggcttggtccagccgagggcgtccctgagactctcctgtacagccgcctggattcaacttttcgngtattatgccagtagaaccgtggggtccccgccgagggcctccggaagggggaacggggcgttaggggaggtttggggttaggtttttaccagttaaggacgcctagtggggtacctttagtcggcgttaggggaaaccaaagacgtaaacgtaccggcccggcgttccgtaggtacggaaaagcgaagtattcatcactctacgaaagngaatggtaacttaccgaaacggctacgtcctaacccgttntcgtagacagacgtacgaacacgaccgaagaacgaccgaacggtacacgtaccgtacttacttacgttacgtaggtttaggttaaggtttagttttacgttaggtttaggtagttagttaacgtttacg

SEQ ID NO: 353610 - DNA, 647 bp, Homo sapiens
  misc_feature: GZ8MTXP02F7EU0.4.33.C11.1.454.CMB.2.raw
  modified_base (242)..(242): a, c, t, g, unknown or other
  misc_feature (242)..(242): n is a, c, g, or t
  modified_base (517)..(517): a, c, t, g, unknown or other
  misc_feature (517)..(517): n is a, c, g, or t
  modified_base (642)..(642): a, c, t, g, unknown or other
  misc_feature (642)..(642): n is a, c, g, or t
tcagagcactgtagcacgaccggtgctcgatttagagtgagctcggttggggtttgggggagctacaacaggcaggcaggggcagcaagatggtgttgcagacccaggtcttcatttctctgttgctctggatctctggtcgccgtacggggacatcgtgatcgacccagtctccagactccgtgctgtgtctcgtgggcgaggacggccacatcaactgacaagtccagcagtagtgttanactacacgtactaccaaacaatcgaaagtaactacgttagtcgttaggtactacgaggacaaacggaaaccgaggacacggtccctaacgtaagcgtagtacctagtaacgttccgggactacggaccggtaaccccccggggtacgtcccggggtacctggaacggtcgtacttcggaacggtggaccgtaggggtccgggtacgtaggggactaggttacttaccaccttcacaccgtaactcgaacgcacgcctgacgacggcaaggtagtntacgggttgaacgtttgtttaactcgtatacgaatacgttacttacttacctacgttaccgtaccgttacggtcggtacgggacgggtaaccgaacggtaagggacgacgtacgaacgtaacggnttcgg

SEQ ID NO: 353611 - DNA, 612 bp, Homo sapiens
  misc_feature: GZ8MTXP02FNS8T.4.33.C11.1.454.CMB.2.raw
  modified_base (200)..(200): a, c, t, g, unknown or other
  misc_feature (200)..(200): n is a, c, g, or t
  modified_base (310)..(310): a, c, t, g, unknown or other
  misc_feature (310)..(310): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtncagctggtggagtctgggggagcttggtccagccagggccggtccctgagactctcctgtaccagcgtctggattcaactttcgtgtatttatgccatgaactgggtccnccacggctccgagggaagggcgtggagtggggtagtttcattaggagcctagtggtcttagtcgcgtagggaacacgagaactacggcccgtcgtcgtggtagaaaggcaggtatcgatcactctacgaaagagactagtacttacccgaaacggacctacgtaccgtaccctaagttccaggtaccagtagtaacgaacgaacgtcccgtaaggaacgaaccgggaacgaccgaacgacgtaccgtccttaattaacgtggtttagttaacggggttattttacggtagttttaggtacgg

SEQ ID NO: 353612 - DNA, 824 bp, Homo sapiens
  misc_feature: GZ8MTXP02JCTZW.4.33.C11.1.454.CMB.2.raw
  modified_base (211)..(211): a, c, t, g, unknown or other
  misc_feature (211)..(211): n is a, c, g, or t
  modified_base (268)..(268): a, c, t, g, unknown or other
  misc_feature (268)..(268): n is a, c, g, or t
  modified_base (290)..(290): a, c, t, g, unknown or other
  misc_feature (290)..(290): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgtcttattttaaaaggtgtccaatgtgaggtgcagctggnggagtcgtgggggagcttggtccagccgagggcggtccctgacgacttctcctgacngcgttctggattcaactttcgngtacttagtcgcctagtcggaaaccgttcggggtccccgaccgaacgggtccgtaccggaaagggggtaaacgggggccgttaggggtaacgggtttcgggggttaaggtttttaccaaagttttacggaacggtaccccgtaagtttcggggaccttttagtaccgggacgttacggggaaactaaccgaagggtaaaccctaccgggtccccgtacggttacgttacgggtaacgggaaaacgggtacccgtaaaggttactttaaccgaacgtttacctaaacgttccttaaacgaaagggttaactaagttacggtaaaccgtttaaaccccgaaaacgggttcccaacgtttacccgacctttacggtacctggaccgaaggttaactacggaaactacggtacccgaagtaaaccggaccggaaacgggaccaaacgtaccggacccttacgttaacgtttaaccggttacggttaaggggtttacggttaacggtttttaaggtttacggtttttaagggtaacggg

SEQ ID NO: 353613 - DNA, 698 bp, Homo sapiens
  misc_feature: GZ8MTXP02HG558.4.33.C11.1.454.CMB.2.raw
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagagcactgtagcacgaccggtgctcgatttagagtgagctcgttgggtttgggggggagaggagccccagccgtgagattcccaggagtttccacttggtgatcagcactgaacacagacccaccaaccatggagtttgggcttagcttgggttttccttgttgcttaattttaaaaggtgtccaatgtgaggtgcagctgggtggagtcgtgggggaggcgttggtccaggcccgaggggccggtccctgagactctcctgtacagcgtctggtattctaactttcgtgtattatcgccatgaacgtcgggtccncaggctcgaggggaggcngggagtgggttagttnagttagngctagtggtacttangcgtagggaacaaacgagaacgtaccggcccgtacgttctaggttagaaaacggcaaagtnttaccataccatcanaaaggatactagtaacttaccgaaacgctacgtacccgtcctaacttcgtacggacaagtagaaaccggaacgtacggacccgtaagggaaaccgaaccggaacggaaccctaacggaccggttaccgttacgttaacgtttacgttagggtttaaggggttttaagggggtttaactttttaacgggtttaaaggtttttcggggaaaggtttacggttaaaacctttaacggtttaaaacccccg

SEQ ID NO: 353614 - DNA, 721 bp, Homo sapiens
  misc_feature: GZ8MTXP02I1LKO.4.33.C11.1.454.CMB.2.raw
  modified_base (274)..(274): a, c, t, g, unknown or other
  misc_feature (274)..(274): n is a, c, g, or t
  modified_base (307)..(307): a, c, t, g, unknown or other
  misc_feature (307)..(307): n is a, c, g, or t
  modified_base (631)..(631): a, c, t, g, unknown or other
  misc_feature (631)..(631): n is a, c, g, or t
  modified_base (658)..(658): a, c, t, g, unknown or other
  misc_feature (658)..(658): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttaattttaaaaggtgtccaatgtgaggtgcagcgtgggtggagtcgtgggggaggtcttggtccagccgaggggccggtccctgacgactcctctgtacngcgtctaggtattctaacgtttgtagtatttancgacctagtacggaaccgttcgggtccccgaccgtacggcccgtaccggaagggggaacggggtcgttaggggagggtttcggggttacggttttaccgaaaggtttaggacgtacccgtaagtcgggtacctttagtcggtcgtaacggggaacccaacggtaacggtaaaaccgttaccggcccccgtacggttacgtagggttaacgggaaaacggcctaaaggtcttacaagttcaaacttcctaaagaaagtaggtatacgttaaccttaccgaaaccgctaacgtcccgtacttacgtcacgatagaagtacgaacgngacccgtaagaacggaaccgacgaacncgaccgtcgtaacttagttcgtgtttaggtttacggtagtttttacgtaggttttacggtaag

SEQ ID NO: 353615 - DNA, 942 bp, Homo sapiens
  misc_feature: GZ8MTXP02FP58E.4.33.C11.1.454.CMB.2.raw
  modified_base (262)..(262): a, c, t, g, unknown or other
  misc_feature (262)..(262): n is a, c, g, or t
tcagagcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgcttattttaaaaggtgtccaatgtgaggtgcagctggtggagtcgtgggggagtcttggtccagccgagggccggtccctgacgactctcctgtacngcgtctggtattctaacgttttcgtgtattatgccagtgaaccgtcggggtcccgccgacggcctaccggaagggggaacggggtcgtggggtaagggttggggtttacggttttacgaagtttacggacggtaccctaagttcggggtacttttaggtcccggtaccgtaggggaaaacccaaaacggtaaggtaaaaccttacccggggcccggtaccggttaccggttagggtaacgggaaaacggggtcaaaggtaactttccaattaccctaagttaccctaaagaaaagtagtaacgttacggtaaaccgtttacccgaaaaccgggcctaaccgttaccccggtacctttaacgtcccgtttaagaccggaaagtaaacgttaacggaaaccccgacggttaaccccggtaacgggaaaaacccggggtaaaccccggggaaaacgggtaaccccgtaaacccgggaaaccggtttacccccccggtttaacggttttaaaacgtttttaccggggtttaacggggtttttaacgggggttttttaaaacggggggttttaaaggtttttttttaaaccgggggttttaacggttttttttttaacggggggaaggttttaaaacgggggtttaaaacctttttaaaacccttttttaaaaaacccccccggg

SEQ ID NO: 353616 - DNA, 646 bp, Homo sapiens
  misc_feature: GZ8MTXP02IYP7Z.4.33.C11.1.454.CMB.2.raw
  modified_base (264)..(264): a, c, t, g, unknown or other
  misc_feature (264)..(264): n is a, c, g, or t
  modified_base (314)..(314): a, c, t, g, unknown or other
  misc_feature (314)..(314): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcggtccctgagcctctcctgtacngcgtctggattcaactttcgtgtattatgccagtgaaccgtcgggtcccncgacggcctacggaaggggaagggcgtagggaggttggggttagtttcaagttagacgtccaagttggctttagtcggcgtagggaaccaacgagtaaactaccggccgtcgtcgtaggtagaaaaggcaagtacttacgattcgatccgtacgaaagagtagtagtaacttacccgaaacggtctaacgtcccgtacttaacgttccgtagtacgaaggtatacgaaacgcgtaccgtaacggaaacgaccggaacggtaccaaacgtcgtaccgtacttaagttaacgtggtttaaggttacggttagttttacggttagtttcggtaag

SEQ ID NO: 353617 - DNA, 646 bp, Homo sapiens
  misc_feature: GZ8MTXP02JOU2A.4.33.C11.1.454.CMB.2.raw
  modified_base (184)..(184): a, c, t, g, unknown or other
  misc_feature (184)..(184): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggngtccaatgtgaggtgcagctggtggagtcgtgggggaggcttggtccagccgagggcgtccctgacgacctctcctgtacagcgtactggattctaacgtttcgtgattatcgcctatgaacgtgggtcccgcgaggctccgaggggaggggctggaggtgggtagttcagttagacgccagtcggcttagtcgcgtagggacacgagtaaactaccggccgtcgtcgtagggtacgaaaaggcaaggtactacactactatacctacgaaaggtagagttagtaaaccgttacccgaaaccggtcctaacgtcccggtaccttactaccgtgacaggtaactcggaaacctacggccgtaacggaaacgacccggaaacgaacgaccgtacgtaccgttcttaacgttaacgtcggttaacgggttagggttaacgttttacggttacgttttagggtaag

SEQ ID NO: 353618 - DNA, 713 bp, Homo sapiens
  misc_feature: GZ8MTXP02FOKKU.4.33.C11.1.454.CMB.2.raw
  modified_base (326)..(326): a, c, t, g, unknown or other
  misc_feature (326)..(326): n is a, c, g, or t
tcagagcactgtagcacgaccggtgctcgatttagagtgagctcgttgggttggggggagctacaacaggcaggcagggggcagcaagatggtgttgcagacccaggtcttcatttctctgttgctctggatctctggtgccgtacggggacatcgtgatcgacccagtcctccagacctcccgtggctgtgtctcgtgggcgaggacggccacatacaactgacaacgtccagcagtagtagttatatacagtcctacaaacaagtaggaaactaacttacgttacgtcgttaggtactacgagacaaacgaaaccgacggaacnctaccctactaagctcgcctacgttaaccggttaccgggacaccggtacccggtaacccccggggtacgtccccggggtacctaggacggtacgttcttacggcgggtcgggacgtacggggtccggggttacgacgggtaactacgttactttacccactacctaccaacgtactcgacgacctacgccgtgacgtacgtacgaaggtaagtcgtgggtacgtaaccgtttagtttacgttacgtacggtactaacgtactaaactttacttaccttaaccttacccgttaccggttaccggttaccggtttaccggggaacggggtaacggtaacgggtaacgggtacggtaacgtaacgtaaaccggtaaacgtacggttacgg

SEQ ID NO: 353619 - DNA, 635 bp, Homo sapiens
  misc_feature: GZ8MTXP02HC63D.4.33.C11.1.454.CMB.2.raw
  modified_base (189)..(189): a, c, t, g, unknown or other
  misc_feature (189)..(189): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagcttgggttttccttgttgcttaattttaaaaggtntaccaatgtgaggtgcagcgtgggtggagtcggtgggggagtcttggtccagccgaggggccgtccctgagactctcctgtacngcgtntggtattcaatttcgngtattancgccagtgaaccgtgggtcccncgaggccgtaccggaggggaagggcgtgggaggttgggttaggtttcagttagacgtctaagtcggtacttagcgtcgtaggggaaccaagagaacgtccgccgtcgtcgtaggtacggaaaggtcaagttactcaatacataccgaataaagatagtacgtaacgtccgaagctacgtcctaccgttatccgtagcgtaagtacgacgaaaccgtcgaccgtaaggaacccgacggtacgaactacgaacgtccttacgttaaatcgttacggttagttacgggtttactttacggttacgttttaggaag

SEQ ID NO: 353620 - DNA, 595 bp, Homo sapiens
  misc_feature: GZ8MTXP02JJ28M.4.33.C11.1.454.CMB.2.raw
  modified_base (289)..(289): a, c, t, g, unknown or other
  misc_feature (289)..(289): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccataaactgacaagtcagccagagtgttatatacagctacaacatgaagaactactagcttaggtatcagacaagaaaccnggaacacgacctacctaagctgaccctacgtaacgtttacccggggacacggtaccgtaaccccggggaacgttcccccgggggtaccctaggacggtccgtaacttccggagggttcggcaagggtccgggtacgtacgggactagtacttcaactctacacatcacgctacgccagcgtaggctaggagcgtagtcggtacttagttatacgtgtactagacttatacttactactactaccggtacgtaacgttcggacggtacgacggtaaggcgtaacgacgtaacaaaccgtgtacgtcg

SEQ ID NO: 353621 - DNA, 559 bp, Homo sapiens
  misc_feature: GZ8MTXP02FF971.4.33.C11.1.454.CMB.2.raw
  modified_base (184)..(184): a, c, t, g, unknown or other
  misc_feature (184)..(184): n is a, c, g, or t
  modified_base (304)..(304): a, c, t, g, unknown or other
  misc_feature (304)..(304): n is a, c, g, or t
  modified_base (426)..(426): a, c, t, g, unknown or other
  misc_feature (426)..(426): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttgggcttagctgggttttccttgttgctattttaaaaggngtccaatgtgaggtgcagctggtggagtcgtgggggagcttggtccagccagggcgtccctgagctctcctgtacagcgtctggattcaactttcgtgattatgccatgaactgggtccnccaggctccgaggggaaggggtctggagtggggtaggtttcattaggacgccagtggtcttatgcgtaggggacaacacggaaataccggccgcgtctgtagaaagcagattcatcatctanaagagatgactcgaaacggcatcgccctatccgtgacagtactaggaaacacgccctagaacgacgacggacacgacgccgtactaataacgtcgtggttaacggggtagttttacgtaagttttcgggtaag

SEQ ID NO: 353622 - DNA, 574 bp, Homo sapiens
  misc_feature: GZ8MTXP02HQUVQ.4.33.C11.1.454.CMB.2.raw
  modified_base (259)..(259): a, c, t, g, unknown or other
  misc_feature (259)..(259): n is a, c, g, or t
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
  modified_base (462)..(462): a, c, t, g, unknown or other
  misc_feature (462)..(462): n is a, c, g, or t
  modified_base (553)..(553): a, c, t, g, unknown or other
  misc_feature (553)..(553): n is a, c, g, or t
tcagagcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagtgttatatacagctactaaacaatgaanaaactacttagcttggatcagcaagaaaccaggacacgcctcctaaagctgctcagttaccggnacgcgtaaccccggggaatcccggggccnggacgcgtattccgagttcggacgacggtccgggggttcgacgggaccagttactttcccaactcctacaaccctatccgaagcgacgccctgacgacggctaggaaagngtgtaggacttaggtttacttacgtcgtagatactaaaattctacgtactactcgtacgtacgttcgacggacggtaacgaagggtacganacgtaacgaaacgtaacgtgg

SEQ ID NO: 353623 - DNA, 647 bp, Homo sapiens
  misc_feature: GZ8MTXP02JTSO2.4.33.C11.1.454.CMB.2.raw
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacgggcccaacatacaactgacaacgtccagcagngtagttanatacagctacaacatagagtaactacttagcttaggtactcagacaacgaaaccgaggaacacgcctaccaacgcgtacgtctactaacgtttaccgggactacggtccgtaaccccccggggtaagttccccggggtaccctaggacgtcgtaacttccgaaggtcggacgacgggtcggggttcgtacggggtactaacgttctttaccgaacttccacctaaccacgtacacggcacgtcctacggaccgcggttacgaggtaaagcgtacgggttacgtaacgttacggttttaattaccgtgttaacgagtactaaattacttcctacgtacctcgtacggttacgttcgggaccggtaggaaccgtagggtagactacgaactaaacgacgtacgg

SEQ ID NO: 353624 - DNA, 702 bp, Homo sapiens
  misc_feature: GZ8MTXP02JHRFO.4.33.C11.1.454.CMB.2.raw
  modified_base (262)..(262): a, c, t, g, unknown or other
  misc_feature (262)..(262): n is a, c, g, or t
tcagagcactgtagcacgaccggtgctcgatttagagtgagctcgttgggtttggggggagaggagccccagccgtgagattcccaggagtttccacttggtgatcagcactgaacacagaccaccaaccatggagtttgggcttagcttgggttttccttgttgcttaattttaaaaggtgtccaatgtgaggtgcagctggtggagtcgtgggggagcttggccagccgagggccgtccctgacgtactctccgtgtacngtcgttctggtacttctaacgtttcgtagtattatgcctatcgaactcgggtacccgccaggtcctaccggaaggggtacgggcgtaggggtaaggttggggttaggtttcaagtttaggacgtcctaagtggtactttagtccggtcgtaggggaaccaaagacgaaacgttaccgcccggtcgttaccgttaggtaaggaaaacggcctaagtactttacatacctaagttcccgaagaagtagtacgtaggtaacgtttacccaaacgggtctacgtacccgtacctttactcgtagacctagaactacgaactcggactagaacggacgacggaacacgaccgtaccgtagttaaccgtttagtacggtttgggttacggttaagtttcgtttaaggttttaggtacgttacggtaactttacgtttaaaaccccg

SEQ ID NO: 353625 - DNA, 628 bp, Homo sapiens
  misc_feature: GZ8MTXP02FO0HZ.4.33.C11.1.454.CMB.2.raw
  modified_base (245)..(245): a, c, t, g, unknown or other
  misc_feature (245)..(245): n is a, c, g, or t
  modified_base (459)..(459): a, c, t, g, unknown or other
  misc_feature (459)..(459): n is a, c, g, or t
tcagagcactgtagcacgaccggtgctcgatttagagtgagctcgttgggtttggggggagctacaacaggcaggcaggggcagcaagatggtgttgcagacccaggtcttcatttctctgttgctctggatctctggtgcctacggggacatcgtgatgacccagtctccagactcccgtggctgtgtctcgtggggcgaggacgggccaaccatacaactgacaagtccagccagagtgttanatacagctaccaaacaatgaagtaaactacttagcttaggtatcaagacaagaaaccaggacacgccctacgtaagctcgcctacgtacgttaccgggacacggtaccgtacccccgggtaacgtcccggggtcctaggacgcgtacttccgagtcggacgagggtccggggttacgtagggaacctagtaactttccaactctacaaccctanccgagcacgcctcggacgacggctagagtagtcggtagtaccgttagtttacgtactggtacaagtactaaacttacttactaacctacgttcccgttacggtactttacggggacggtaaccgggtaacgaagggtacggaacgtaactaacgtaaacgtacgtacgg

SEQ ID NO: 353626 - DNA, 770 bp, Homo sapiens
  misc_feature: GZ8MTXP02HSG2R.4.33.C11.1.454.CMB.2.raw
  modified_base (258)..(258): a, c, t, g, unknown or other
  misc_feature (258)..(258): n is a, c, g, or t
  modified_base (285)..(285): a, c, t, g, unknown or other
  misc_feature (285)..(285): n is a, c, g, or t
tcagagcactgtagcacgaccggtgctcgatttagagtgagctcgttggggttgggggagctacaacaggcaggcagggggcagcaagatggtgttgcagacccaggtcttcatttctctgttgctctggatctctggtgccgtacggggacatcgtgatcgacccagtctccagacctcccgtggctgtgtctcgtggggcgagacgggccacatcaactgacaagtccagccagagtgttatatacagctaccaanaatgaagtaactacttagcttaggtancagacaagaaaccgaggaccacgaccccttacgaagcctgtcctaccgtaacgtttacccggggctaacggaccccggtaaccccccggggtaacgtcccccgggggttacccctgggacggtacccggtaatttccggaagggtcgggaccgacggggttaccgggggtactagggggaaacctaggttactttacccgacgttaccctacctaaacccgtaacttacccgaacggcccgtaacggaccccgttgggacccgttaaaggggacccgttaagggaaaacgttaggtttccggggtaagggttaccgtttaaaaggtttttactaaccgttggtaccaaagtacctaaatttacgtttacccttaaaccgtcctttaaccccggttcggtttaccggtttaccggggaaccggggttaacgggaaccgttaaagggggagtaaacggtactaaaccggtaaaaccggtagttcggg

SEQ ID NO: 353627 - DNA, 658 bp, Homo sapiens
  misc_feature: GZ8MTXP02H9CTP.4.33.C11.1.454.CMB.2.raw
  modified_base (287)..(287): a, c, t, g, unknown or other
  misc_feature (287)..(287): n is a, c, g, or t
  modified_base (319)..(319): a, c, t, g, unknown or other
  misc_feature (319)..(319): n is a, c, g, or t
  modified_base (480)..(480): a, c, t, g, unknown or other
  misc_feature (480)..(480): n is a, c, g, or t
  modified_base (530)..(530): a, c, t, g, unknown or other
  misc_feature (530)..(530): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccgagggcggtccctgagactctcctgtacagcgtctggtattcaacttttcgngtatttatgaccctatgaaacctggggtcccnccaagggcctaccggaaggggaaggggctggggaaggttggggttaaggtttcaagtttaggacgtccctaagtgggtactttagtggtcgttaggggaaccaacgagaaaacttccggcccgtcgttcgtagggtagaaaggcagattacatcatcctanaagagatgacttacccgaacggacacgtcgcctaatcctagacaagtaanacgaacgacgtaccgtaacgaaacggaccggaaacggaaccgtaaccgacgtacccgttacttaacgttaacgttaggttacggtttaacgggtttacggttttaacggtttaggttttagggtaacg

SEQ ID NO: 353628 - DNA, 612 bp, Homo sapiens
  misc_feature: GZ8MTXP02GX5PY.4.33.C11.1.454.CMB.2.raw
  modified_base (295)..(295): a, c, t, g, unknown or other
  misc_feature (295)..(295): n is a, c, g, or t
  modified_base (350)..(350): a, c, t, g, unknown or other
  misc_feature (350)..(350): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
  modified_base (507)..(507): a, c, t, g, unknown or other
  misc_feature (507)..(507): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtggggcgaggacgggccaccgatacaactgacaagtccagccagacgtgttatatacagctaccaacaatcgaagtaactactagtcttacggtatcagcgaanaaaccgaggacacgtacctaccgtaaagctagaccttcgtaagtttacccggganacgtaccgtacccccgggtaacgtccggggtacctaggacgtacggacttgaacgtcggctacgggccggggtctggggaaccagtatttaccacttcactacatccgaagccagaccgtgaccgagtntagaagctagngtactagttatacggtntacgtactataactacttacttacgtaccgtaccgttacggtacgttccgggaacggtacggaacggtaagggtacgacgtaacgtaaaccgaacgtacgtacgg

SEQ ID NO: 353629 - DNA, 723 bp, Homo sapiens
  misc_feature: GZ8MTXP02FM4BH.4.33.C11.1.454.CMB.2.raw
  modified_base (324)..(324): a, c, t, g, unknown or other
  misc_feature (324)..(324): n is a, c, g, or t
  modified_base (488)..(488): a, c, t, g, unknown or other
  misc_feature (488)..(488): n is a, c, g, or t
tcagagcactgtagcacgaccggtgctcgatttagagtgagctcgttgggtttgggggagctctgggagaggagccccagccgtgagattcccaggagtttccacttggtgatcagcactgaacacagaccaccaaccatggagttgggcttagctgggttttccttgttgctatttaaaaggtgtccaatgtgaggtgcagctggtggagtcgtgggggaggtcttggtccagccgaggggccggtccctgagacctctccgtgtacagcgtctggtattctaactttcgtgtattatcgcctatcggaacgtcggggtcccnccgaggcctccggaagggggaacggggctaggggacgggttggggttaacgggttttcaagtttacggacggtacctaagttcggggtacctttaagtcggacgttacggggaacctaacggagtaaacgtaccgcccgtcgttcgtaggtaggaaaacgggtnagtacttcaactcaacgttacctacaaagggagtacgtagtaacttacccgaaaacgggtctacgtaccgtcctatccgtagaccaggtaacgtgaaaacgacgcccgtaaggaaaaccggaaccgggaaggaacccgtaacgaccgggttacccttacggttaactttaaccggttaggttacggggtttaacggggtttagtttttaacgggttagtttttaacggggtaagg

SEQ ID NO: 353630 - DNA, 784 bp, Homo sapiens
  misc_feature: GZ8MTXP02IXCGJ.4.33.C11.1.454.CMB.2.raw
  modified_base (261)..(261): a, c, t, g, unknown or other
  misc_feature (261)..(261): n is a, c, g, or t
tcagagcactgtagcacgaccggtgctcgatttagagtgagctcgttggggttggggggagctacaacaggcaggcaggggcagcaagatggtgttgcagacccaggtcttcatttctctgttgctctggatctctggtgccgtacggggacatcgtgatgacccagtctccagacctccgtggctgtgtctcgtgggcgagacgggccaaccatcaactgcaagtccagccaagagtgttatatacagctaccaaacaangaagaaactacttagcttaggtactacagacaagaaaccaggaaccacgacctacctaagctcgctacgtacgtttaccggcagaccgtaccccggggtaaacgtcccgggggtccctaggacgtaccggtattaccggtaaggtcgggaccgtaggggtaccgggggttaccggtttagggggaaccctaaaggggtaacgtttttacccgaaccgttacccgttaccgaaacccgtaacttacccgaaagggtaccaaacgaccccgttggaccgaaacggggtaccgttaacggtaaaaggtaaacggtttcgggtaagggtacccgtttaaacgggtttttaaatttaacccgttagggtttaccaaaggtaccgttaaaaattaacgtttaaacctttaaccggtaaccctttaacccggttacgggtaaaccgttttccgggacggggtaacggggaacccggtaaaggtaacggggtaaggtaacgtaaccgtaaaacggtaaaccgttaaacggg

SEQ ID NO: 353631 - DNA, 899 bp, Homo sapiens
  misc_feature: GZ8MTXP02IYK7U.4.33.C11.1.454.CMB.2.raw
tcagagcactgtagcacgaccggtgctcgatttagagtgagctcgttgggtttggggagctctgggagaggagccccagccgtgagattcccaggagtttccacttggtgatcagcactgaacacagaccaccaaccatggagtttggcttagctggttttcctgttgctatttaaagtgtccaatgtgagtgcagctggtggagtcgtgggggagcttggtccagccgagggcgtccctgagactctcctgtacagcgtctggattcaactttcgtgtactttatcgtccaattacggaaccgttcggggtccccgaccgtagggtcccgtacccgggaaagggggtaacgggggtccgttagggggtaaggggtttagggggtttaacgggtttaccgttttttttttaaacggaaggtaaccgggtaccccgtaaaggtttcggggtaccgttttaaagtcgggtaccggttaacgggggaaaacccaaacggtaaacgggtaaaaccttaacccggggtcccccgtaccgggtttaccgttaagggttaaaggggaaaaacggggtccgttaaaaggtaacgttttaccgaaagttaccctaacgtttaccttaaaccgaaaaggttaacggaaacgttgttaaaaccgtttaaccccgaaaacgggtacccgttaacttacccggtaccttaaacttcgtacgacgaaagtaagttaacggaaaaccgtacggacccgttaaagggaaaaccggaacccgggaaacgggttaaaacccacgtaaccggtacccggtttaacctttaaagtttaaccggtttaagggtttaacgggttttaaggggtttaaaaccgttttttacggtttaacggttttttaacggggtttaaggg

SEQ ID NO: 353632 - DNA, 634 bp, Homo sapiens
  misc_feature: GZ8MTXP02FIFCM.4.33.C11.1.454.CMB.2.raw
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (340)..(341): a, c, t, g, unknown or other
  misc_feature (340)..(341): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (415)..(415): a, c, t, g, unknown or other
  misc_feature (415)..(415): n is a, c, g, or t
tcagagcactgtagcacgaccggtgctcgatttagagtgagctcgttgggtttggggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtcgtgggggagcttggtccagccagggcggtcctgagactctcctgtacagcgtctggattcaactttcgngattagccatgaactgggccncaggctcgaggggagggctggagtgggtagttcatgagcnnggnttangcgtagggacaacgagaactcgccgcgtcttaggtagaagtcagattacatctatactactaaaganagttacgaacgttacccgaacggtactaacgtccggtaccttacgttctaggaccaagtacgtacgaaacgtacggaccggtaacggaaacggaccggaaacggaaccgaaccgacggtacccgtaacttaacgtttaccgttaggtacgggtttaaaggggtaacgttttaacgttagtttttacgggagtttacggtaattaaccgtttaaaccccg

SEQ ID NO: 353633 - DNA, 673 bp, Homo sapiens
  misc_feature: GZ8MTXP02ICVLW.4.33.C11.1.454.CMB.2.raw
tcagagcactgtagcacgaccggtgctcgatttagagtgagctcgttggggtttggggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaaactgcaagtccagccagagtgttatatacagctaccaacaatgaagaactacttaagcttggtaatcagcaagaaaaccaggacaagccctactaagctgctctaatttaaccggggcaacggtctaaacccccccggggaaattaccccgggggtcccctagacggacggaatttccaggtggcgaggccgggttcgtagggacaaggactttacactctacaaccctatacaagccaacgcttacgcaacgggtctagaaagtagtaggtacggtacgtaagtttaagtttaaaccgtgttacaacggtaccaaaatttaacgtttacgttaaaccgtaaacctttacccggttacccgggttaacgtttaccgggtaccgggttaaccggggtaaaccggaaccgggtaaagggttaaccgggaagtttaaccgaaaaacggtaaaccgtaaacgg

SEQ ID NO: 353634 - DNA, 612 bp, Homo sapiens
  misc_feature: GZ8MTXP02I96IE.4.33.C11.1.454.CMB.2.raw
  modified_base (471)..(471): a, c, t, g, unknown or other
  misc_feature (471)..(471): n is a, c, g, or t
tcagagcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtggcgagacgggccacatcaactgacaagtccagccagagttgttaatatacagcctaccaaacaatgaagaactacgttagcttggtatcagcaagaaaccaggacacgccctactaagctagcctactacgtttaccgggctaacggtcccgtaaccccccggggaacgttcccccggggtaccaggacgccgtaattccgaaggtcggcgacgggcggtcgagggaccagtacttcgactcgtaccactatcacgcagctagaccaggtcagaagngtaggtgtacgttagtttatcgtgtactagactaattacttacctactaccgttaccgtaccggttacggttacccgggaggtaaccgggtaaaccgtagggggtacgaacgtaacgtacccgaaaaggttaccttcgggg

SEQ ID NO: 353635 - DNA, 682 bp, Homo sapiens
  misc_feature: GZ8MTXP02FWK1G.4.33.C11.1.454.CMB.2.raw
  modified_base (427)..(427): a, c, t, g, unknown or other
  misc_feature (427)..(427): n is a, c, g, or t
tcagagcactgtagcacgaccggtgctcgatttagagtgagctcgttggggtttggggggagctacaacaggcaggcaggggcagcaagatggtgttgcagacccaggtcttcatttctctgttgctctggatctctggtgccgtacggggacatcgtgatcgacccagtctccagactcccgtggctgtgtctgtgggcgagacggccacataccaatgacaagtccagccagtagtgttatatacagctacaaacaatgaaagtaaactacttagtcttggtatacaagcaacgaaaccgaggacacgtaccctacgtaagctagtcctcgtaacgttaccgggactacggaccgtaacccccgggacgtcccggggtacctggacgacgtacttccgaggtcggtacggaggtccgggttacgngggtaactagttactttcaccttacctaccaaccctagtacccgaagtacccgacgtacccgtggaaaccggtcgggtaccgtaaggtaaagcgtttaagggtaccgttaagtttaccggttttaattccggtagtacccggaagttactaacttaacttaccgtaaacttaccgttaccggttaccggttacgttaccgggacggtacgggaaaccgtagggtacgaaggtaacttaacgaaacggtacgtcgg

SEQ ID NO: 353636 - DNA, 634 bp, Homo sapiens
  misc_feature: GZ8MTXP02GZP9Y.4.33.C11.1.454.CMB.2.raw
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
  modified_base (484)..(484): a, c, t, g, unknown or other
  misc_feature (484)..(484): n is a, c, g, or t
tcagagcactgtagcacgaccggtgctcgatttagagtgagctcgttggggtttgggggggagaggagccccagccgtgagattcccaggagtttccacttggtgatcagcactgaacacagaccaccaaccatggagtttgggcttagctgggttttcctgttgcttattttaaaaggtgtccaatgtgaggtgcagctgggtggagtcgtgggggaggcttggtccagccaggggccgtcctgagactctcctgtacagcgtctggattctaactttcgngtattatcgccatgactggccncgaggctccgaggggagggctggagtgggtagttcagttagancatggcttatcgctggacaacngaatcgcgcgtctgtagaaagcaagtattcaagtcatacgataaacgagtactggaactttccgaaacgggtctaacgtccgaccttaagttcctaggactaaggacttagaacncggactagaaacggcccgaaagggaacaccgtaaacgggtcccgttacgttaaacttaccggttacggttaggtttaaaacgggggttaacggtttttacgtagggtttttacgggacgtttacggtaaactttaacggtttaaaccccc

SEQ ID NO: 353637 - DNA, 786 bp, Homo sapiens
  misc_feature: GZ8MTXP02FQC4W.4.33.C11.1.454.CMB.2.raw
  modified_base (262)..(262): a, c, t, g, unknown or other
  misc_feature (262)..(262): n is a, c, g, or t
tcagagcactgtagcacgaccggtgctcgatttagagtgagctcgttgggtttggggagctctgggagaggagccccagccgtgagattcccaggagtttccacttggtgatcagcactgaacacagaccaccaaccatggagttggcttagctgggttttccttgttgctattttaaaaggtgtccaatgtgaggtgcagctgggtggagtcgtgggggaggcttggtccagccgagggcgtccctgagctctcctgtacngcgtctggattcaaacgttttcgtagtatttatcgtacctatacgtaaacgtcggggtaccccgccgaagggcctaccggaaggggaaaggggcttaggggaaggtggggttaaggttttcaagtttaggacgtccgtaagttcgggtctttaaagtcgcggttaacggggaaacctaacgaagtaaaactaccgggtacccgaccggttactgggttaaacgggaaaagccgtaaaggtaatttaccgaattacaaacttactaacaaaagggtaccgtaaaagttggtaaacctttaaaccccgaaacggtactaccgtacccggtaccctttaattcccgaggtaccaaagtattaacggaaaaccgacgtaccccgtaaaggaaaacccggtaacgggaacccgggaaataaaccggaccgtaaacccggtttactttaaacgtttaacggttaggtttaacgggtttaaacggggtttttacggttttaaacggtttaggggtttttaacgggtaacgg

SEQ ID NO: 353638 - DNA, 540 bp, Homo sapiens
  misc_feature: GZ8MTXP01BF6PC.10.23.C01.1.454.CMB.2.raw
  modified_base (378)..(378): a, c, t, g, unknown or other
  misc_feature (378)..(378): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (529)..(529): a, c, t, g, unknown or other
  misc_feature (529)..(529): n is a, c, g, or t
tcagcatagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaaggcctggagtgggtctcaggtattgattggaatagtggtaccattgcctatgcggactctgtgaagggccattcaccatcaccagagacgacgccaggagctccctgtatctaccaaaatgaaacagtctgagacctgaaggacacggcctttggtactttactggtagtaaaggaggggtatcgtaaggggtttcaaattattatagtaagtggttaangaactacgtggggcaggggaccctggtcacgtctctcacgccctccaaccacgggcccagtccgtcctccccgtggccgccctgcctccgagcgccactccgncgcacngccggccttgggcttcgcctggcaaggcctaactccaatacnttcgcttgcgg

SEQ ID NO: 353639 - DNA, 673 bp, Homo sapiens
  misc_feature: GZ8MTXP01CWIAQ.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctatttaaaggtgtcagtgtgaagtgcagctggtggagtcgtgggggagtcttggtacagcctggcaggtccctgacgctctcctgtgcacgcctctggattcagtctttgatgaatatgccagtcggacgtgggtcccgacgtaaggtttcccggaagggggaacggccgtaggggacggttcgggggttacccctacggtaagggttatttagggaagtttaagggaaattgggttacgggttaaccctaagtttcgaccgttagtcggacgggtacttcgtaggtacggaacggggtcctaacttaccgaaccctatacccgaaaccgaaggacgaaccggaccgaccggaacgggacgtcctacccgtagtactacctaacctaaaatcgaaactagtctaacggaacgtaaccgttgggaacgttacgaccggtctttaggttaacttacggtaaggtaggtaaggtagggtacgttcgtaagggtttaactaaag

SEQ ID NO: 353640 - DNA, 678 bp, Homo sapiens
  misc_feature: GZ8MTXP01C2R5Q.10.23.C01.1.454.CMB.2.raw
  modified_base (654)..(654): a, c, t, g, unknown or other
  misc_feature (654)..(654): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagcctggcaggtccctgagacctctcctgtcgcagcctctggattcagtctttgatagaatatgccagtcgggacgtcggggtccggactaacggttccggaagggggtaaggcccgtaggggaggttcggggtcctcggtaagggttagttggtaagtttaagggtaaagttgggttacgggtaaccctaagtttcgacctagttgggaccggtacttcgtaggtacgggaacggggtcccgtaagttaccaacctactacccgaaccgaggaacggaaccgaccggaccggaacgggtacgtcccttacccgtagtaaccttacctaacccgtaaaagtcgtaaaccgtacgtacgtacggaacgtaccgttagggacgaccgtaccggtcctttagttacttacgtgtaggtaaggngggtagttcgtaaggtttctaaag

SEQ ID NO: 353641 - DNA, 693 bp, Homo sapiens
  misc_feature: GZ8MTXP01CAFNY.10.23.C01.1.454.CMB.2.raw
  modified_base (607)..(607): a, c, t, g, unknown or other
  misc_feature (607)..(607): n is a, c, g, or t
  modified_base (666)..(666): a, c, t, g, unknown or other
  misc_feature (666)..(666): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctgggtggagtcgtgggggagcttggtacagcctggcaggtccctgagtactctctgtcgcagcctctggtacttcagtctttgatgaatatcgaccagtcgggtaccgttcgggggtaccggactaacgggtttcccggaaaggggggtaacgggtcccgttgggggtaacggtcgggggttaccccttacgggtaaggggtttagtttagggtaaaggtttaagggtaaaagtttaaggggtcgggttaaaccctaagttttcggacccgttaaggtcgggtaccgggtaacttcgtagggtagggaaacgggtcccgtaattaccgaacctatacccgaccgaagacgaacgaccgccggaagggactccttccgtagtactacctacaaatcgtaaaccngtcctgaacgcttaggacggacctacgggtcttaggttcttacgtggtaaggtaacggnggtacgttacgtaacgggtttaacaag

SEQ ID NO: 353642 - DNA, 818 bp, Homo sapiens
  misc_feature: GZ8MTXP01BCE9Z.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaggtgtccagtgtgaagtgcagctggtggagtcgtgggggagtcttggtacagcctggcaggtccctgagactctcctgtgcagcctctggattcagtctttgatagaatatcgcctagtcgggacgtcgggggtacccggacgtaaacgggtttcccggaagggggaacgggtccgtagggggaggttcgggggttaccctcgggtaagggtttagtttagggaagtttaaggggtaaagttaacggggttacgggttaaccctaagtttcggtaccccgtttaagtcgggtaccgggtacctttcggtacggggttacggggaacgggggtacccctacgttttaccccgaaaccctaacgttacccgaaacccgaagggaaccgggtaacccggaaccccgggacccggtaaacgggggtaacctccccgtttacccccggttaggttaaacccttacccgttaaaccccgtaaaaagttccgtaaaaccgtacggttccgtaaggaaaccgtaacccgttaggggaaaccggttacccgtaaccgggttcctttaggttacgtttacggttaagggttaggtaaaggggtagggggtacgttaccgggttaaggggttttaaccttaaaagg

SEQ ID NO: 353643 - DNA, 623 bp, Homo sapiens
  misc_feature: GZ8MTXP01ETVXO.10.23.C01.1.454.CMB.2.raw
  modified_base (298)..(298): a, c, t, g, unknown or other
  misc_feature (298)..(298): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagtcttggtacagccgtggcacggtccctgacgacctctcctgtgcagcctgtggattcgagtctttgatgaatntcggaccagtcggacgttcggggtccggactaacggtttccggaagggggacgggtccgtaggggacggttcggggtcctacggtaggttattggaagtttagggaaattgggtacgtaccgtattcgtacctagtggaccggtactcgtaggtggaacgggccgtattaccaccataccacgagacgacgaccgcgaggcgtctcctagtactacctactaaatacgaactagtcgtgaactacgttggaacggaccgaccgggtcttagttacgttacgtggtaggtaagggaggggtagttacggtaagggtttaactaaag

SEQ ID NO: 353644 - DNA, 651 bp, Homo sapiens
  misc_feature: GZ8MTXP01EUART.10.23.C01.1.454.CMB.2.raw
  modified_base (625)..(625): a, c, t, g, unknown or other
  misc_feature (625)..(625): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctgggtggagtcgtgggggaggcttggtacagcctggcaggtccctgagactctcctgtgcagcctctggattcagtctttgatgaatatgccagtggacgtcggggtccggacgtaacggtttccgaagggggacggtccgtggggaggttcggggtcctcggtaggttagttggaagtttagggaaattgggtcgggtaaccctagtttcgacctagtcggcggtacttcgtggtacgggaacggggccctaatttcccaactactccaaaccgaaggaacgaaccgaccggaccggaaggaccgtcctaccccgtagtaacctccgtaaccaaaagttcgaaactagttccaggaacgtacccttggaacggaccgtacgggttccttaggttactttacgtggtagttaaaggggnggtagttacgttaacggtttaacaag

SEQ ID NO: 353645 - DNA, 697 bp, Homo sapiens
  misc_feature: GZ8MTXP01AJDWO.10.23.C01.1.454.CMB.2.raw
  modified_base (296)..(296): a, c, t, g, unknown or other
  misc_feature (296)..(296): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagccgtggcaggtccctgacgactctcctgtgcagcctctggattcgagtctttgatgaatntgccagtcggacgttgggggtcccggactaacggtttcccggaagggggtaacgggtcccgtaggggtacggttcgggggtaccctacggtagggttattaggtaagtttaagggaaattgggtacgggtaaccctagtttcggacccttagtcggtaccgggtacttcgtaggtacgggaacggggtcccgtaaattaaacccagtaccaaccgagacgaccggaccgaccgaaggggacgtccgttccctaggtaacctcctaaccgtaaagtacgaaacctagtaccgtaggaacgaacccgtagggacggggccttaaccgggtcctttaggttacttcggttaggtaaggtaaagggtgggtacggtacgttaacggggtttaacaaacgtttaag

SEQ ID NO: 353646 - DNA, 728 bp, Homo sapiens
  misc_feature: GZ8MTXP01BTTMM.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggcttatttaaaggtgtcagtgtgaagtgcagctggtggagtcgtgggggagtcttggtacagcctggcaggtccctgagacctctccgtgtcgcagtcctcgtggtattcgagtctttagatgaatatcgcctagtcggacgtcggggtcccggtacgtaacgggttccggaagggggtacgggccgtaggggacggttcgggttcccctaggtagggttagttaggtagtttaagggaaagttcgggttacgggtaaaccctgtttcggtacccgttagtacgggtaccggttaacttccggtagggttaacggggaaacggggttcccgtaacgtttacccgaacctaactacccgaaccgtaaacggaacggaaccggtacccgacggggtacggtacggtcccttacccgtagtacctaccgtaaccaaattcgaaactacgttccgaggaaccgtaccgttagggaacgaccggttaacgggtcccttttagttactttaggtaaggttaggtaaggtacggggtagttaccgttaaggggtttaacctaaag

SEQ ID NO: 353647 - DNA, 752 bp, Homo sapiens
  misc_feature: GZ8MTXP01AYVS9.10.23.C01.1.454.CMB.2.raw
  modified_base (576)..(576): a, c, t, g, unknown or other
  misc_feature (576)..(576): n is a, c, g, or t
tcagcatagtagtgcacgaccggtgctcgatttagtacacgtgatcagggattggggagctctgggagaggagccccagccctgagattcccaggtgtttccattcagtgatcagcactgaacacagaggactcaccatggagttgggactgagctggtattttccttttggcttaattttaaaggtgtccagtgtgaagtgcagctgggtggagtcgtgggggagtcgttggtacagccgtgggcacggtccctgagtacctctcctgtcgcagcctcgtggtacttcgagttctttagattagaaattgtgcctagtcggacgtcgggggttaccggacgtaaacggtttccggaagggggaacggtccggtagggacggttcggggtctacggtaagggtttagttagtaaaggtttagggtaagttagggttagggttaaccctagtttcgacccttaggtcgggtaccggtattcggtagggtacgggtaaccgggtcccgttaacttaccgaacctacgtacccaaacccgaaggaaccgaccgggaccggggaccgaaacggggtaccnccccgttacccgttggtaaccttacccgtaaacccgaaattaccggaaacgtcggttccgtaaggaaccggttacccggtaggaaaccggtaccggtaccggttccgtttagttaactttaacgggtagttaacgggtaaagggacgggttacggttaacggttaagggttttaac

SEQ ID NO: 353648 - DNA, 724 bp, Homo sapiens
  misc_feature: GZ8MTXP01CNSJA.10.23.C01.1.454.CMB.2.raw
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtatttttccttttggtcttaattttaaaaggtgtcagtgtgaagtgcagctggtggagtcgtggggggagtcgttggtacagccgtggccaggtccctgacgtactctcgtgtncngcctcgtggtattcagtctttgatagaatatgcctagtcggacgtcggggtccgacgtaaggttccggagggggacggtccgtggggtaggttcgggtcctaggtaggttagttaggtagttaagggaaacttgggtacgtaaccctagtttcggaccttagtcgggtacccggtaccgtttgttacgggtacgggaaacgggtcccgtaacgttacccaaccctacgtacccgaaacccgaagggaaccggaacccggaaccggtaccgggaacggggtaacccgtcccttaccccggtagttaacccttaccctaaacctaaaacgttcgaaacctacggtacgtacgaaacggtaccttaggggaacgttccgtaaacgggttcctttagttacgtttcgtaaggtagtaacgggagggtacgttacgttaacgggtttaactaaag

SEQ ID NO: 353649 - DNA, 743 bp, Homo sapiens
  misc_feature: GZ8MTXP01CAY2Z.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctattttaaaggtgtccagtgtgaagtgcagctggtggagtcgtgggggagtcttggtacagcctggcagggtccctgacgactctcctgtgcagcctctggattcgagtctttgatgaatatgacctagtgggacgttgggggtacccggactaacggtttcccggaagggggaacggggtcccgtagggggaggttcgggggttaccctaccgggtagggttatttagggtagtttaaggggaaattcgggttacgggtaaccctagtttcggtacccttagtcgggacggtacgttcgtacggttacgggaacggggtcccgtactttacccgacctacgtaccgaacccgaagaacggaaccgggacccggaccgggaacggggtaccgtcccttaccccgttagtaacccttccgtaaccaaaacgttcggaaaccgtacggttaccgtacggaacggtaaccccgttgggaaccggaccgtaacccgggtcctttacggttacgtttacgtaagggttaggttaacgggtaggggtacgttacggtaacggggttttctaaaacg

SEQ ID NO: 353650 - DNA, 633 bp, Homo sapiens
  misc_feature: GZ8MTXP01EOJIR.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctattttaaaggtgtccagtgtgaagtgcagctggtggagtcgtgggggaggcttggtacagcctggcaggtccctgagactctcctgtgcagcctctggattcagtctttgatgaatatgccagtggacgttgggtccgctaaggttccgaagggggtacgggcctgggagtgggtcctgtaggtatgtagttaagggaattggtggtaacctagttcgtacctagtcggcggtacttcgtggttaggaacgggtcccgtaagtttcccaaccgtactaccgaaccgaaggaacgaaccggaccgacccggagggaccgtccttacccgtagtactacctacgaaaactgtaacctgttctggaacgtaccgttggacggacgtaccggttccttaggttactttacgtgggttaaggtaagggtgggggtacgttaccggtaaggggttttaactaaag

SEQ ID NO: 353651 - DNA, 741 bp, Homo sapiens
  misc_feature: GZ8MTXP01AS6UZ.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaggtgtccagtgtgaagtgcagctggtggagtcgtgggggagcttggtacagcctggcaggtccctgacgtactctcctgtgcagcctctggattcgagtctttgatagaatgtcgccagtcgggacgtcggggtaccggacgtaacggtttccggaagggggtaacggccgtaggggtacggttcggggttacccgttacggtaggggttatttagggaagttttaagggaaagtttaacgggtacgggttaaaccctagtttcggacccgttagtcgggtacccggtacttccgtaggtacgggaacggggtcctagtttaccgacctagtaccgaacgtacggaacggaccggaacccggcccggggaaaggggtcccgtacccgttacccgttaggttaacctccgtaaaccccgtaaaagtcgtaaaaccgtcgttacgtggaacggtacccgttggaacggttacgtacccgggttcgttacgttaagttaccggtaagggttacggaaacgggtggggtaaccggttacggttaacgggttttaacctaaag

SEQ ID NO: 353652 - DNA, 879 bp, Homo sapiens
  misc_feature: GZ8MTXP01D9JMT.10.23.C01.1.454.CMB.2.raw
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggctatttaaaaggtgtccagtgtgaagtgcagctggtggagtcgtgggggagtcttgggacagcctggcaggtccctgagacctctcctgtncagccctntggattcagtctttggatgaatagtcgacctagtcggtacgtcgggggtcccggacgtaaacggtttccggaagggggtaacgggtcccgtagggggaacgggttcggggttaccctacggtaaggggtttattaggtaagttttaaggggaaatttcgggttacgggttaaaccctagtttacggtacccgttaaggtcgggacccggtaacgttccggttaggttaacgggaacggggtcccgtaaacgtttacccgaacctaacgttacccgaaacccgtaaagggaaccgggtaaacccgtaacccgggaccccggggtaaaacgggggtccgttaaccccctttcccccggttaaggttaaacccgtttaccccgtttaaacccgtaaaaaaaccgtttaccgggtaaaaccttaaccgggttaccgttaaacgggaaaacccggtaccccggttaagggaaacccggggttaaaccccgtaacccggggttaccccgttttaagggttaacgttttaaccgttaaggggttaacgggtaaaagggtaacgggggttacggtttaaacccgggtttaagggggtttttaacccgttaaaaacgg

SEQ ID NO: 353653 - DNA, 769 bp, Homo sapiens
  misc_feature: GZ8MTXP01BL94X.10.23.C01.1.454.CMB.2.raw
  modified_base (288)..(288): a, c, t, g, unknown or other
  misc_feature (288)..(288): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtatttttcctttggacttaattttaaaaggtgtccagtgtgaagtgcagctgggtggagtcggtgggggagtcttggtacagccgtggcacggtccctgacgacctcgtcctgtcgcagtcctcgtggtnttcgagtctttagatagtaatagtcgaccgtaggttcggggtaccgttcgggggtaccccggtagtaaccggggtttccggaaaggggggtacgggtccgtgggggtacgggttacgggttcccgtacggtaagggtttatttaggaaggtttaagggtaaagttcggggttacggtaaccctagttcggtaccttaggtcggtacgggtaccttgtagggtacgggaacggggtcctacgttacccaacgactaccgaacgacgggaacgaaccgggacccgacgaacggggcttcccttacccgttataaccgttacccgtacaaaaacgtcgtaaaccgtacgttacgaacgggaaaccggtaccgttaggggaaacccggttacgaaccgggtttcccgtttaaggttacgtttacggtaaggttaacggtaaggggtaggggttacgttacgggttaaccggttttaataaaacgg

SEQ ID NO: 353654 - DNA, 675 bp, Homo sapiens
  misc_feature: GZ8MTXP02F8DKN.10.23.C01.1.454.CMB.2.raw
  modified_base (269)..(269): a, c, t, g, unknown or other
  misc_feature (269)..(269): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagcgtgagtttcctttaggctatttaaagtgtcagtgtgaagtgcagctggtggagtctgggggagcttggtacagcctggcaggtccctgagactctcctgtgcagctctggatcngcttgatgatatgcatgatggtcggcagtccaggaaggccgtggagtgggtcgtcaggtagttgtagttaggtaagtaggtagggtaccgtaaagttaggtcccttaacgtttaggtacggggacccttacgttcggtttcgggtaaagggggtacccgggggaaacgttttccgtaacccgtaaccgtaaccgtaacccccaacggaaaggaaaccggaaacccggacccgaacccgggaaggggaaacgtaccccgtcccgttaaagttccgtttacccctaaaaacgtaacgtaacgtaacgtacgtacgtacgtaccgtacggacggtacgtaccggtaccgttacgttaacgttacgttaagttacgtaaggtacggtaggtacggtacggttacgtaacg

SEQ ID NO: 353655 - DNA, 557 bp, Homo sapiens
  misc_feature: GZ8MTXP02GJ2MM.10.23.C01.1.454.CMB.2.raw
tcagcatagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggtccttgtattactgtagtaaagagggagtcagggtttcaaactattatagtagttggttatgactacgtggggccaggggaaccctgggtccaccgtctcctcacgccctccaccaacgggccccagtccggtcctcccccgtggccgccctgcctccgaggacgccacctccgagacgcacagccggcccgtgggcctgccgtcggtacaacggtacctaaccgttccccacttactactcgcctagacggg

SEQ ID NO: 353656 - DNA, 534 bp, Homo sapiens
  misc_feature: GZ8MTXP02JNLF2.10.23.C01.1.454.CMB.2.raw
  modified_base (426)..(426): a, c, t, g, unknown or other
  misc_feature (426)..(426): n is a, c, g, or t
  modified_base (457)..(457): a, c, t, g, unknown or other
  misc_feature (457)..(457): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcagtctttgatgaatatgccatggactgggtccgcaagttccgaggggaagggcctggagtgggtcctcgaggtatgattggaatggtgtaccattgcctatgcggactctgtgaagggcattcaccatcaccagacgacgacgcaagggcncctcccgtagtactctaccaaaatcgaaacngtcagacgacctggacggacacggtccttagtattacgtgtagtaaggagggtacgtacgtacgggtttactaaaag

SEQ ID NO: 353657 - DNA, 519 bp, Homo sapiens
  misc_feature: GZ8MTXP02FZ76C.10.23.C01.1.454.CMB.2.raw
  modified_base (306)..(306): a, c, t, g, unknown or other
  misc_feature (306)..(306): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (445)..(445): a, c, t, g, unknown or other
  misc_feature (445)..(445): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctgggggagcttggtacagcctggcaggtccctgagactctcctgtgcagcctctggattcagctttgatgaatatgcagtggactgggtccgnaagttccgaggggaggcctggagtggtctcgagtatgattggaatgtgtacattgcctagtgcggtactcgtgtgaacgggcattcacatcacagacgacgacnccgaggncctccgtgtactctaccaaatcgaaacngtctgacacgtagacggacacggtccttagtacttactggtagaaaggagggtatacggtaggtttacctaaag

SEQ ID NO: 353658 - DNA, 554 bp, Homo sapiens
  misc_feature: GZ8MTXP02H7DAB.10.23.C01.1.454.CMB.2.raw
  modified_base (271)..(271): a, c, t, g, unknown or other
  misc_feature (271)..(271): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (529)..(529): a, c, t, g, unknown or other
  misc_feature (529)..(529): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggaggcttggtacagcctggcaggtccctgagactctcctgtgcagcctcnggattcagtctttgatgaatatgcatggactgggtccgctaaggttccgaggggaggcctgggagtggtccngaggtntgagttggaatgtggtacagtttcgcctagtgcgactcgtggtagagggccgattcaccgatcaaccgagacgaccgacgaccgaggacgcctcccgtagtactcctaacctaaatcgaaacagtctaggacgaccgtggaacgacgaccggtaccttgtacttacgtgtaggtaaaggngggtacgttacgtaggtttacaaag

SEQ ID NO: 353659 - DNA, 586 bp, Homo sapiens
  misc_feature: GZ8MTXP02H33IO.10.23.C01.1.454.CMB.2.raw
  modified_base (411)..(411): a, c, t, g, unknown or other
  misc_feature (411)..(411): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggaggcgttggtacagcctggcaggtccctgagactctcctgtgcagcctctggattcagtctttgatgaatatgccagtggacgtggggtccgctaaggttccgaaggggacgggcctggggaggtgggtcctcgagggttatggagttggaataggtgggtaaccagttgcctagtcgcggacttcgngtagaacgggccgattcgaccatccaccgagagaccgacgccgaggacgcctcccgtagtactcctaaccaaaagtcggaaactcgtctacgacgacccgtggaacggaccaccgggtccttaggtaacttacgtggtaaggtaacggacggagttaccgtaagggtttacaaag

SEQ ID NO: 353660 - DNA, 542 bp, Homo sapiens
  misc_feature: GZ8MTXP02FWJBH.10.23.C01.1.454.CMB.2.raw
  modified_base (311)..(311): a, c, t, g, unknown or other
  misc_feature (311)..(311): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgagactctcctgtgcagcctctggattcagtctttgatgaatatgccagtggactgggtccgnaagtccgaggggaggctggagtggctgagtatgatggatgtgtacattcgctatgcgtatcgtgtgaacgggctattcactatcaccgagacgacgaccgcgaggacgcctcccgtagtactctaccgaaatcgaacagtctagaacgtaccgtaggaacggaccgacggtacctttagtaactttacgtggtagtaaaggacgggtagttacggacgggtttactaaacg

SEQ ID NO: 353661 - DNA, 715 bp, Homo sapiens
  misc_feature: GZ8MTXP02FYID1.10.23.C01.1.454.CMB.2.raw
  modified_base (293)..(293): a, c, t, g, unknown or other
  misc_feature (293)..(293): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggaggcttggtacagcctggcaggtccctgagactctcctgtgcagcctctggattcagtctttgatgaatangccagtggacgtggggtccgctaacgttccgaaggggtaacgggccgtagggtaggtgggtccctcgtaggtattggattagggaattgggtcggtaacctagttcgccttaagtcggacggtactcgtggtaggaaacggggtccgtaagttccaacctactacccgaaccgaaacggaacggaaacccggaaccggacccgaaacggggaccgtaccccgttacccccgttagttaacctccgttaaacccaaaagttacggaaacctaacggtacgtaacggaacggtaaccccgtagggaaaccggggtaacccgtaccgggttaccctttaacggttaacgtttaaccggtaaggttaacgggtaaaacgggtaagggggtacggttacggttaaacgggggtttaccttaaaacgg

SEQ ID NO: 353662 - DNA, 604 bp, Homo sapiens
  misc_feature: GZ8MTXP02IU50J.10.23.C01.1.454.CMB.2.raw
  modified_base (456)..(456): a, c, t, g, unknown or other
  misc_feature (456)..(456): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctgtcaggtccctgagactctcctgtgcagcctctggattcagtctttgatgaatatgaccagtggacgtgggtccgctaaggttccgaaggggaacggcctgggagtgggtcctcgaggtatgattggaatggtggtacctattgcctagtgcgacttcgtggtagaacggggcctattccacctataccgaaccaggaacgaccgacgcccgaagggacnccctacccgtgtaacctctaaccaaagtacgaactacgtaccaggaacgaccgtaggaacggtaccgaaccggggttcctttaggttaactttaccgtaaggttaggtaaacgggagggtacgttaccggttaagggtttacctaaag

SEQ ID NO: 353663 - DNA, 635 bp, Homo sapiens
  misc_feature: GZ8MTXP02GTSC2.10.23.C01.1.454.CMB.2.raw
  modified_base (271)..(271): a, c, t, g, unknown or other
  misc_feature (271)..(271): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcttggtacagcctggcaggtccctgacgactctcctgtgcagcctntggattcagtcttgatgaatatgccagtggacgtggggtccgcgtaaggttccgaggggacggccgtgggaggttgggtcctcgaggttatgagttggaatggtggtacctagttcgccttagtcggaccggtacttcgtaggtaggaaacgggggtccctattaccaccgtatacccaaccgagacgaaccggaccgaccgacgggacgacccttcccgtacgtaactcctaaccaaagttacgaaaccgtacgtacgtacggaacgtaccggtaggaacggtaccgaccgggtaccttaggttaactttacgtggttaaggtaaggtacggggtacgttacggtaacggggtttacctaaag

SEQ ID NO: 353664 - DNA, 538 bp, Homo sapiens
  misc_feature: GZ8MTXP02JBT23.10.23.C01.1.454.CMB.2.raw
  modified_base (306)..(306): a, c, t, g, unknown or other
  misc_feature (306)..(306): n is a, c, g, or t
  modified_base (457)..(457): a, c, t, g, unknown or other
  misc_feature (457)..(457): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagcgtggatttcctttaggctatttaaaggtgtccagtgtgaagtgcagctggtggagtcgtgggggagcttggtacagcctggcaggtccctgagctctcctgtgcagcctctggattcagtctttgatgaatatgccatggactgggtccgnaagtccagggaggcctggagtgggtcctgaggtattgattggaatggtggtaaccagttgcctagtgcggtactctgtgaaggccgattcacccatcaccagacgaccgacgccgaggacgcctccctgtatcctaacaaatcgaaaaccngtcagacgacgagaacggacctacggtccttagtacttacgtaagtagtaacggacgggtagtacggtacggtttacaaag

SEQ ID NO: 353665 - DNA, 552 bp, Homo sapiens
  misc_feature: GZ8MTXP02FKOVG.10.23.C01.1.454.CMB.2.raw
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (359)..(359): a, c, t, g, unknown or other
  misc_feature (359)..(359): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
tcagcatagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaaggcctggagtgggtctcaggtattgattggaatagtggtaccattgcctatgcggactctgtgaagggccattcaccatcaccagagacgacgccaggagctcccngtatctccaaatgaacagtctganacctgaggacacggccttgtattactgtgtaagagggagtcaggggtttcaactattatagtagtggttangactacgtggggccagggaaccctggtcaccgtctcctcacgccctccaccaacgggcccagtccgtccttcccccnggccncccctgcctcccgaggaccgcaccctccgacgagccacacgccggccctggggcctcgccgtggtaccaacgggtacctaaccgttcccaactacgtaatcgctggacggg

SEQ ID NO: 353666 - DNA, 572 bp, Homo sapiens
  misc_feature: GZ8MTXP02F75LA.10.23.C01.1.454.CMB.2.raw
  modified_base (455)..(455): a, c, t, g, unknown or other
  misc_feature (455)..(455): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggaggcttggtacagcctggcaggtccctgagactctccgtgtgcagcctcgtggattcagtctttgatgaatatgcagtggactggggtccgactaagttccgaggggaacggccgtgggagtgggtcctcgagtatgattggaatggtgtactattgcctagtcggcgtatcgtgtaggaaacgggcgtattacccgacctaatccaaccgagacgaacgacgaccgaggacnccttaccgtagtactccgtacaaaatcgaacagttacaggaacgtaccgtaggacgacgaccggtccttgttactacgtaaggtagtaacggtaggattacggtaggtttactaaag

SEQ ID NO: 353667 - DNA, 565 bp, Homo sapiens
  misc_feature: GZ8MTXP02HHS5F.10.23.C01.1.454.CMB.2.raw
tcagcatagtagtgcacgaccggtgctcgatttagtacacgtgattagggattgggaggcttggtacagcctggcaggtccctgagactctcctgtgcagcctctggattcagctttgatgaatatgccatggactgggtccgcaagttccagggaagggcctggagtgggtctcgaggtattgattggaatagtggtaccattgcctatgcggactctgtgaagggccgattcaccatcaccagagacgacgccaggagcctccctgtactcctaccaaaatgaaacagtctgaacgtacctgacggacacggtccttgtaactttacgtgtagtaaaggaggggatcgaagggtttcaaacgttattaataggtacgtgttatgactacgtggggccagggaaccctgcaccgtctcctcagccctacaccgaacgggcccacgtccgtccttccccgtgcccgtccctgcctccgagacgccaccgtcgagacgcacgacgcgtccgtggctacgccgtcgacgaacggactaacctcccaacttactactcgcgttagcgg

SEQ ID NO: 353668 - DNA, 643 bp, Homo sapiens
  misc_feature: GZ8MTXP02F3B94.10.23.C01.1.454.CMB.2.raw
  modified_base (495)..(495): a, c, t, g, unknown or other
  misc_feature (495)..(495): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggctattttaaaggtgtccagtgtgaagtgcagctggtggagtcgtgggggagcttggtacagcctggcaggtccctgagactctctgtgcagcctctggattcagtctttgatgaatatgccagtggactggggtccggacaaaggttcccgaaggggaacgggtcctggggagtggggtcctcgaggtattggtatttaggggaaattgggtgggtaaccctagtttcggaccttaagtcggcgggtaactcgttggtaggaacggggtccctaaatttccaaccctatcccaaaccgagacgaaccgacgtccgaaaggggcncccttacccgtagtaacctcgttaacccaaaattgaacacgtacgtagtacgaccgtacggacggaacgaccggtaccgttacgttaacgttacgttaagtacggttaacggtaacgggtaaggtacggtacggtttacggttaaacg

SEQ ID NO: 353669 - DNA, 676 bp, Homo sapiens
  misc_feature: GZ8MTXP02JBD00.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggaggcgttggtacagcctggcaggtcctgagctctcctgtgcagcctcgtgattcagtctttgatgaatatcgacctagtcggacgttcggggtaccggacaaacgggtttccgaaggggaacggggtccgtggggaaggttcggggtacccttacgtagggtttattagggtaagtttagggaaacttagggttcgggtaaccctaagtttccgaccttagtcgggtaccggtacttcgtaggtacgggaaacggggtccgtaacttccaacccgtactaccgaaaccaacggacggaaacccgaccgaaccgacgggacgtccctacccgtagtaacttaccgtaaccaaagtcgaaacgtagtacacgaacgacccgtaggaaacggtaccaccgggttcttaggttactacgtaagtagaaggtaggagttacggtacggttactaaag

SEQ ID NO: 353670 - DNA, 696 bp, Homo sapiens
  misc_feature: GZ8MTXP02HM819.10.23.C01.1.454.CMB.2.raw
  modified_base (271)..(271): a, c, t, g, unknown or other
  misc_feature (271)..(271): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcgttggtacagcctggcaggtccctgacgctctcctgtgcacgcctntggattcagtctttgatagtaatagtcgcctagtcggacgtcggggtccggactaaacgggttccggaaggggtaacgggtccgtggggaggttcggggtaccgttacggtaagggtttattaggtaagtttggggaaaacgttaggggttacgggttaaaccctagtttcggacccgtttaagtcgggtaccgggtacttcgtagggttacggaacggggtacccgtatttacccgaaccgtactacccgaacccgtaggaacggaaaccggaccgaccgtagggacctcccgtacccgtgtaactctaacctaaatcgaaccagtctagaccgtaccgaggaacggacgtaccggtaccttagttaacgttacgtaaggtaggtaaacgggtagggtacggttacgtacgggtttactaaacg

SEQ ID NO: 353671 - DNA, 700 bp, Homo sapiens
  misc_feature: GZ8MTXP02HG0UP.10.23.C01.1.454.CMB.2.raw
  modified_base (291)..(291): a, c, t, g, unknown or other
  misc_feature (291)..(291): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctattttaaaggtgtccagtgtgaagtgcagctggtggagtcgtgggggagcttggtacagcctggcaggtccctgacgactctctgtgcagcctctggattcagtctttgatagaatntgccagtggactggggtccgacaaggttccgaggggaaggccgtggaggtggtcctcgaggttattggagttaggaaattgggtcgggttaacctagttcgaccttagtcgggtaccggtacttcgtaggtacggaaacggggtcccgtaagtttaccaccctaagtacccaaccgaacggaacggaaccggaacccggaccgaacggggtaaccgtcccgttaccccgtagttaaccttacccgtaaccctaaaagttacggaaaccctagttacccgtaaggtaaccgtaacccgttagggaaccggaaccggtaaccgggttcccgttttaggttaactttacgtaaggttaacggtaaaacgggtaggggtaacgttaccggtaacggggttttacctaaaacgg

SEQ ID NO: 353672 - DNA, 571 bp, Homo sapiens
  misc_feature: GZ8MTXP02H3G9W.10.23.C01.1.454.CMB.2.raw
  modified_base (450)..(450): a, c, t, g, unknown or other
  misc_feature (450)..(450): n is a, c, g, or t
  modified_base (484)..(484): a, c, t, g, unknown or other
  misc_feature (484)..(484): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggcttattttaaaggtgtccagtgtgaagtgcagctggtggagtcgtgggggaggcttggtacagcctggcaggtccctgagactctcctgtgcagcctctggattcagtctttgatgaatatgccatggactggggtccgcaagtccgaggggaacggccgtgggagtgggtcctcgagttattgattggaatggtggtaccattcgcctagtgcggtactcgtaggtagacgggccgattccgacctatccaccgagacgacggaccgaccgacggacncctcccgtagtactcctacaaatcgaactagtcngacgtaccgtggacggtacgcggtaccttaggtactttacgtgttacggtaaaggcgggtacgtacgttaacggggtttactaaacg

SEQ ID NO: 353673 - DNA, 767 bp, Homo sapiens
  misc_feature: GZ8MTXP02JV79N.10.23.C01.1.454.CMB.2.raw
tcagcatagtagtgcacgaccggtgctcgatttagtacacgtgattagggattggggagctctgggagaggagccccagccctgagactcccaggtgtttccattcagtgatcagcactgaacacagaggactcaccatggagttgggactgagctggattttccttttggcttattttaaaaggtgtccagtgtgaagtgcagctggtggagtcgtgggggaggcttggtacagcctggcaggtccctgagactctcctgtgcagcctctggattcagtctttgatagaatatgcctagtggacgtggggtaccggactaacggttccgaaggggtacgggccgtggggaggttcggggtccctacggaggtttagttgggtaagtttaggggaaatttacgggtgggttaaccctagtttcgaccttagtcgggccgggtaacttcggttaggttacgggaacgggggtcccgtaagtttaccgaaccctacgtacccgaaacccgacggaaccggaaaccggaacccggacccgaacgggggaaccgcccctttccccccgttaggttaaacccttcccgttaaacccgaaaaacgttacggaaaaccgtacgggtttaccgtaacggtaaccggtaaccccgttagggaacggaaacccggtaccggggttaccctttagggttaactttaaccggtaaggttacggttaaaaggggacgggggttaacgttaccggttaaaggggttttaccctttaaaacg

SEQ ID NO: 353674 - DNA, 756 bp, Homo sapiens
  misc_feature: GZ8MTXP02JWAKW.10.23.C01.1.454.CMB.2.raw
  modified_base (294)..(294): a, c, t, g, unknown or other
  misc_feature (294)..(294): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggagtcgtgggggaggtcttggtacagcctggcaggtccctgagctctctgtgcagcctgtggattcagtctttgatgaatntcgccagtcggacgtggggtcccgacgtaacggttccggaagggggaacgggtccgtaggggacggttggggtcccctacggtagggttagttggaagtttaggaaattcggggtacggtaaccctagtttaccgccgttaagtcgggaccggtaccttggttaggtaggggtaaacgggggtcccgtaacgtttaccaaccccgtaattccgaacttaccgaaggaaacggacccgaccggacccgaaggggcctcccttaccccgtaggtaaccttacccgtaaacctaaaagtcggtaaacctaaggttcccgtaaggaaaccggtacccggttagggaaaccgggtaacccgtaaccggggttcccttttaaggttaaacgtttaaccggttagggttaaacggggttaaaacggggtagggggtaaccggtttacggttaaccgggggtttttaaac

SEQ ID NO: 353675 - DNA, 689 bp, Homo sapiens
  misc_feature: GZ8MTXP02IF0WD.10.23.C01.1.454.CMB.2.raw
  modified_base (292)..(292): a, c, t, g, unknown or other
  misc_feature (292)..(292): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcttggtacagcctggcaggtccctgagactctcctgtgcagcctctggattcagtctttgatgaatntgccagtggactgggtccgctaagttccgagggacggcctgggaggtgggtcctcgaggtattgattagggaattgggtcggtaacctagtttcgacccttagtcggtccggtacttcgtggttacggaacgggggcccgtacttaccgaaccctactacccgaaccgaacgaacggaaccggaacccggaccgaacggggaccgtcccgttaccccgtagttaaccttaccgttaacccaaaagttacggaaactagttaccgtaggaaccgtaccgtagggaaacgggtaaccgtaaccgggttacccgtttaaggtttacgtttaacgtaaggttacggtaaaacgggtagggggtaacggtttacggttaaacggggtttaactttaaaacgg

SEQ ID NO: 353676 - DNA, 645 bp, Homo sapiens
  misc_feature: GZ8MTXP02F66EA.10.23.C01.1.454.CMB.2.raw
  modified_base (292)..(292): a, c, t, g, unknown or other
  misc_feature (292)..(292): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtgggggagcttggtacagcctggcaggtccctgagactctcctgtgcagcctctggattcagtctttgatgaatntgccagtggacgtggggtccggcaaaggttccgaaggggtaacgggcctggggaggtggggtcctcgaggtattgattagggaatggtgggtaacctagtttcgccttagtggccgggtaacttcgttaggtaggaaacgggggtcccgtaatttcccaaccctactacccaaccgaagacggaaccggtaccgcccgaagggacgtcccttccccgttagttacctcctaacccaaaatcgaaaactagtcctaggaacgtaccgtaggaacgggacctaccgggtcctttagtaactttaacgtggttaggtaaacggaggggtacgtacggtaacgggttttacaaaacg

SEQ ID NO: 353677 - DNA, 761 bp, Homo sapiens
  misc_feature: GZ8MTXP02IP9TE.10.23.C01.1.454.CMB.2.raw
  modified_base (581)..(581): a, c, t, g, unknown or other
  misc_feature (581)..(581): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaggtgtccagtgtgaagtgcagctggtggagtcgtgggggagcgttggtacagccgtgggccgacggtccctgacgtacttcctcctgtcgcacgtcctgtggtacttcgagtcgtttagatagaattagtcgtccgtagtcgggtaccggttggggtacccgacgtaaacgggttccggaaggggtaacggtccgtagggtaggtcgggtcctacggtaggttagttagtagttaggtaacgtgggttacgggtaactaggttcgtacccgttagtcggggtaccgtaactttcggtacggtagggaaacggggtccgttaacgtttacccgaaacccttacgtacccgaaacccgtaagggacggaaacccgggacccggaccggaagggggtaccncccccgtttacccgtaggttaacccttaccctaaaccgtaaaagtacgtaaaccgtacgttcgtaacggtaacggtaccgttaggggaaacgtaccggtacccgggttccttttaagtactttacggtaagttaacggtaaagggtacggggttattaccggtttaagggtttaactaag

SEQ ID NO: 353678 - DNA, 590 bp, Homo sapiens
  misc_feature: GZ8MTXP02I2OUL.10.23.C01.1.454.CMB.2.raw
  modified_base (297)..(297): a, c, t, g, unknown or other
  misc_feature (297)..(297): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttaagttttaaaaggtgtccagtgtgaagtgcagctggtggagtcgtgggggagcgttggtacagcctggcaggtccctgagactctcctgtgcagcctgtggattcgagtctttgatagaatntcgccatggactgggtccgactaaggttccgaggggacggccgtggaggtggtcctgagttatgagttggaaatggtcggtacctagtttcgaccttagtcgacggtactcgtggtacggaacggggtcctattccaaccactacaccgagacgaccgacgaccgaggcgccctacccgtagtactctaaccctaaagtacgaaaccgtagtccagtacgacgtaggacgaaccgcggtaccttagtacttacgtaaggtagtaacggaggtactcgtaacggtttactaaag

SEQ ID NO: 353679 - DNA, 664 bp, Homo sapiens
  misc_feature: GZ8MTXP02JK5FR.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggaggcttggtacagcctggcaggtccctgagctctcctgtgcagcctcgtggattcagtctttgatagaatatgaccagtcggacgtggggtcccggactaacggttccggaaggggtaacgggccgttggggaggttcgggtccctacgtaggttagtttggtaagttagggtaaagttacggttcgggttaaaccgtacgtttacgtacccgttaagttcgggaccgggtacgttccgttaggttacgggaacggggtacctacgttacaccgataccgacacgacgaaccgaccgaccgtacggacgtacctcccgtagtacctacctaccgtaaatacgaactacgtactacgaacgaccgtaggacggaaccgtacggtccgttacgtattacgtaaggtacggtaaggacggtagtacgtaaggttacttaaacg

SEQ ID NO: 353680 - DNA, 615 bp, Homo sapiens
  misc_feature: GZ8MTXP02IP7G9.10.23.C01.1.454.CMB.2.raw
  modified_base (492)..(492): a, c, t, g, unknown or other
  misc_feature (492)..(492): n is a, c, g, or t
  modified_base (505)..(505): a, c, t, g, unknown or other
  misc_feature (505)..(505): n is a, c, g, or t
tcagcatagtagtgcacgaccggtgctcgatttagtacacgtgattagggattggggagctctgggagaggagccccagccctgagattcccaggtgtttccattcagtgatcagcactgaacacagagactcaccatggagtgggactgagctggtattttccttttggcttaattttaaaggtgtccagtgtgaagtgcagcgtggtggagtcgtgggggagtcgttggtacagcccgtggcacgggtccctgagtcctctcctgtgcacgcctgtggacttcagtctttgatagaatagtcgaccagtcgggaccggtggggtaccccgacgtaaacggttcccggaaggggtacgggtccgtggggtaggttcggtccgtacgtaggttagttagtagttaggaattgggtacgtacctagttcgccttagcggtacgtactgtggtagacggcgtattcacctatccacgagacgacgacgcgagcncctcgtacgtacnctacaagtacgactagtcgacgacgtaccgtagacggtaccgacggttcttacgtacttacgtaaggttaggtaaggtacgggtagtttaccggtaggtttaacctaaag

SEQ ID NO: 353681 - DNA, 645 bp, Homo sapiens
  misc_feature: GZ8MTXP02HK1YT.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagcttggtacagcctggcaggtccctgagactctcctgtgcagcctctggattcagtctttgatgaatatgccagtcggacgtcggggtccggactaaggttccgaaggggaacgggccgtaggggacggttggggtcctacgaaggttattggaagtttgggaaattggtcgggtaacctagtttcgaccttagtcggtcggaacttcgtggttacggaacggggtcccgtaatttccaacctactaccaacccgagaacggaaccgaccgacccgaggacgcctcccgtagtactacctaaccaaagtcgaaacagttaccagacgaccgtaggaacggtaccgaccggttccgttagttaacttaccgtaaggtacggtaaacggtacggggtagtaccggtaagggttttacctaaacg

SEQ ID NO: 353682 - DNA, 682 bp, Homo sapiens
  misc_feature: GZ8MTXP02GZX23.10.23.C01.1.454.CMB.2.raw
  modified_base (295)..(295): a, c, t, g, unknown or other
  misc_feature (295)..(295): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggctaattttaaaaggtgtccagtgtgaagtgcagcgtggtggagtcgtgggggaggcttggtacagccgtggcaggtccctgagactctcctgtgcagcctcgtggatcagtctttgatagaatntcgacctagtcggacgtggggtcccggacgtaacggttccggaaggggtaacgtcggtaccggtaggggtacggttccggggtccgtacggtaggtttagtttaggtaaggtttagggtaagtttacgggttagggttaacccgtagtttacgtacccgttagtcgggaccgtacgttccgttaggtacgggaacgggggtccctaattcccgaacctacgtaccaacgacggaaacgaccggacgccgaaggccgtcctaccgtagtactactaccgaaagtcgaaacgtcgtcgtagacgtaccgtaggacggaacctacgggttacctagtttaactaaggttgtaacggttaaggcggtaacgtccggttaaggtttaaaccg

SEQ ID NO: 353683 - DNA, 780 bp, Homo sapiens
  misc_feature: GZ8MTXP02IJNIU.10.23.C01.1.454.CMB.2.raw
  modified_base (290)..(290): a, c, t, g, unknown or other
  misc_feature (290)..(290): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaaggtgtcagtgtgaagtgcagctggtggagtcgtgggggagcgttggtacagcctggcaggtcctgagctctctgtgcagcctgtggattcagtctttgatagaatntgacctagtggaccgtggggtaccggactaacggttccgaaggggacggccgtaggggacggttcggggtcctacgtaggttattggtaagtttaggaacttagggtagttaacccgtagtttcgtaccgttagcgggtaccgggactttcgtagggttaacggaacgggggtacccgtaacgtttaccgaacccgtacgttaacccgaacccgtaaggaaaccggtaaaccggaacccggacccggaacgggaacccgtcccgttacccgttacgttaccttacccttaaaccgtaaaacgtacggtaaaactacggttaccgtaacggtaccggtaaaccgttacgggaaaccggtacccgtaaccgggtttacccgttttaacggtttaactttaaccggggttaaggtttaaacggtaaaacgggggtacgggggttaaacgtttaccggggtttaaaacggggtttttaacccgtttaaaaacgg

SEQ ID NO: 353684 - DNA, 659 bp, Homo sapiens
  misc_feature: GZ8MTXP02GDOQT.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgagactctcctgtcgcacgcctcgtggattcagtctttagatagaatatgcctagtggacgtgggtcccggataaacggttccgaaggggaacggtccgtaggaggtcggtctacgtaggtattgagttagggaatgggtagtacctagttcgcctagtcgacggtacttcgtaggtacggaaacgggtccgtaattaccgacctataccaaccgaaggaacgtaaaccggaccgaccgaagggaccgtacccgtacccgttagtaaccttccgtaaccctaaaagtaccgaaactacggtacgtaggaacggtaacctagggaaccggtaacaccgggtctttaacggttacttaacgtggttaagtaaacgggtagggtacgttacggttaaggggtttacctaaaacg

SEQ ID NO: 353685 - DNA, 759 bp, Homo sapiens
  misc_feature: GZ8MTXP02JHKCF.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagtcttggtacagccgtggcaggtcctgagactctctgtgcagcctcgtggattcgagtctttagatgtaatagtcgacctagtcgggtaccgttcggggtcccggacgtaaacgggtttcccggaaggggtaaaccggggtcccgtaggggtacgggtttcggggtcccttacggtaagggtttattagggtaagttagggtaaagttagggttaggtaaactagttcgtaccttagtcggtacggtacctcgtaggtacggaacggggtcccgtaactttaccaacccgtactacccgaaccgaacggacggaacccggaccggaccggacgggtaccggtcccttacccgttacgttaaccttcccgtaacccgtaaagtcgtaaacgtacgtacgtaacggtaccgacccgttagggaaccgggtaaccgtacccggggttactttacggtaacttttaaccgggtaaggttaacgggtaaaacggtagggggttaacggtttaccggtttaacggggtttaaccttaaacgg

SEQ ID NO: 353686 - DNA, 663 bp, Homo sapiens
  misc_feature: GZ8MTXP02IKKV5.10.23.C01.1.454.CMB.2.raw
  modified_base (268)..(268): a, c, t, g, unknown or other
  misc_feature (268)..(268): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagcttggtacagcctggcaggtccctgagactctctgtgcagcctntggattcagtcttgatgaatangccatggactgggtccgnaaggttccgaggggacggcctggagtgggtcctacgaggtatgagttggaatgggtcgtaccagtttcgacctagtcggacggtacttcgtggttacggaacgggggtcccgtaagtttaccaacccgtaattacccgaaacccgaagaacggaaaccggtaaccggaccgaacggggaaccgtcccttccccgtagttactacctaaccaaaagttacggaaactacgtacgtacggaacgtaacccgtaggaaacgggaaccgaaccgggtcctttaacggttaactttaacggtaaggttacggtaaaacgggtaggggtaacgttacggttaacggggtttacctaaaacg

SEQ ID NO: 353687 - DNA, 781 bp, Homo sapiens
  misc_feature: GZ8MTXP02GNI06.10.23.C01.1.454.CMB.2.raw
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
tcagcatagtagtgcacgaccggtgctcgatttagtacacgtgattagggattgggggagctctgggagaggagccccagccctgagattcccaggtgtttccattcagtgatcagcactgaacacagagactcaccatggagttgggactgagctggtattttccttttggcttaattttaaaggtgtccagtgtgaagtgcagctggtggagtcgtgggggagtcgttggtacagccgtggcacggtccctgacgtctctcctgtcgcacgccctcgtggtatcngtctttgatagatancgccagtcggacgtcgggtcccggagtaacggttccggaaggggtacgggtccgtagggacggtgggtccctaggtaggttattaggagtttagggtaacgttagggttacgttaaccgtagtttcgtacccgttaagtcgggtaccggttacctttcggtaagggttacgggaaaccgggggtccctaaacgtttacccgaaccccgtaaacgttaccccaaacccgggaaaggaacccggaaaccggtacccggaacccgggaaacgggggtaccctaccccggtttaccccggtttaaattacccgttaacccgtaaaccctaaaagttaccggaaactacggtttaacgacggtaaacgaccggttaggaaaccggtaccggtaccggttacctttaaggttaacttaaccggttaaggtaaggttaaaacgggggaggggttacgtaacggtttacgggtttaaacttaaaagg

SEQ ID NO: 353688 - DNA, 574 bp, Homo sapiens
  misc_feature: GZ8MTXP02GIGVU.10.23.C01.1.454.CMB.2.raw
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
  modified_base (358)..(358): a, c, t, g, unknown or other
  misc_feature (358)..(358): n is a, c, g, or t
  modified_base (426)..(426): a, c, t, g, unknown or other
  misc_feature (426)..(426): n is a, c, g, or t
  modified_base (448)..(448): a, c, t, g, unknown or other
  misc_feature (448)..(448): n is a, c, g, or t
  modified_base (511)..(511): a, c, t, g, unknown or other
  misc_feature (511)..(511): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtatttttcctttggcttaagttttaaaaggtgtccagtgtagaagtgcagcgtggtggaggtcggtgggggagtcgttggtacagccgtggcaggtccctgagactctcctgncncgtcctcgtggattcagtctttgatagtaatancgcagtggacgtggtccgcaagtccggagggtacggcgtggaggtggtctgngtatgagttagaatggtgattacgtgcctagtcggcgtactgtggacgacgggtctagtacaccgtancgacagacgacgcgaccgagcncctacctgactaccgacaagtacgaatcgtcaggtacaaccgtggaccgtaacgacccggttntttaacgtacttacgtaagttaggtaacgggtaggtagttacggtaacggtttacttaaaagg

SEQ ID NO: 353689 - DNA, 644 bp, Homo sapiens
  misc_feature: GZ8MTXP02HLDE0.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagagactcaccatggagttgggactgagctggtattttccttttggcttaattttaaaaggtgtccagtgtgaagtgcagctggtggagtcgtgggggagtcttggtacagccgtggcacggtccctgagactctcctgtcgcagcctgtgattcagtctttagatagaatatcgcctagtcgggtacgtcggggtaccggacgtaacggttaccggaggggaacggtccgtgggtagggtcgggtcctacgagggttattaggtagttggtaagtggtaggtacctagttcgtaccttagcggtcggtacctgtacggtagggtaacggggtcccgtatccgaaccaacgtccaacccgaggacgaaaccgccgaccggacggacgtcccttcccgtagtacctacctaaccgtaaacgtacgaacgtactcgtacgaacgaccgtacggacgaccgtacggtccgttagttaactacgtgtaggtaacggacggtagttaccgtaggtttaactaag

SEQ ID NO: 353690 - DNA, 736 bp, Homo sapiens
  misc_feature: GZ8MTXP02FJZ8G.10.23.C01.1.454.CMB.2.raw
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggtatttttccttttggcttaattttaaaaggtgtccagtgtgaagtgcagctggtggagtcgtgggggagtcgttggacagcctggcaggtccctgagactctctgtgcagcctctggattcagtctttgatagaatatgccagtggacgtggggtcccgacgtaaggtccgaagggggtaacgggtccgtgggaggttcggggtcccgttacgtaaggggttatttgggtaagtttaggggaaattagggtcgggtaacctagtttcgacccttagtcggacggtaccttcgttagggtacgggaaacggggtccctaacgtttacccaaaccctagtaccccgaaccgtaaaggaaccgggaaacccgggacccgacccggaacgggaccgtccccgttaccccgttagttaaccctacccttaaaccaaaacgttacggaaaacctacggttaccgaaggtaaccgtaacccggtaggaacccggaaccgtaccggttacccgtttagtaacttttaaccggtaagtaacgggtaaaggacggggtacgtttacggtaacgggtttactaaaacg

SEQ ID NO: 353691 - DNA, 666 bp, Homo sapiens
  misc_feature: GZ8MTXP02FS37S.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtatttttccttttggcttaattttaaaaggtgtccagtgtgaagtgcagcgtggtggagtcgtgggggagtcgttggtacagccgtggcacggtccctgacgactctctgtcgcagtcctgtggattcgagtctttgatagtaatagtcgacctaggtcggtacgtcggggtaccgacgtaacggttccggaaggggtacggtccgtagggtacggtcggttacctacggtaggttattaggtagttaaggtaattgggtacgtacttagttcgaccgttagcggtacgtacgtgtggtagggaacgggtcctaacttaccacctactaccgacgaacgacgaccgaccgacgacggactccctaccgtataccaccgtaacaacgtacgactacgtcgtagaaccggtacgtacggacggtaaccgtacgttaccgttacgtaagtttacggtaaggttaagggtaaacggtagggtacgttaacggttaacggtttaactttaaag

SEQ ID NO: 353692 - DNA, 743 bp, Homo sapiens
  misc_feature: GZ8MTXP02HU50Y.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcttggtacagcctggcaggtccctgagactctctgtgcagcctctggatcagtctttgatgaatatgccagtggacgttggggtcccggactaaggttccgaaggggaacgggtccgtaggggacgtggggtaccctacgtaggggttagtttaggtagtttaggggaacttaggggtaccgggtttaccagtttccgtacccgttagtcgggtaccgggtaccttccgttaggtacggaacggggtacccggtaacttttccgaaaccccgtagttacccaaacccgaacgacggaaacccggacccgacccggtaacgggacggtcccctttacccgtacgttaaccttaacccgttaacccaaaagtaccgtaaacgtaacgttacttacgggaaccgtaacccgttagggaaccggaaaccggtacccggtaccgtttacgggtttaacttaccggttaaggttacgtaaaacgggtgggtaaacggtttacgtaacggggttttactaaaacg

SEQ ID NO: 353693 - DNA, 782 bp, Homo sapiens
  misc_feature: GZ8MTXP02GT8MX.10.23.C01.1.454.CMB.2.raw
  modified_base (411)..(411): a, c, t, g, unknown or other
  misc_feature (411)..(411): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcggtgggggagcgttggtacagcctgggcacggtccctggagtcctctcctgtcgcatccctgtggtactttcagtctttgataggaatacgtgcctagtggtaccgttggggtaccccgactaaacgggtttccggaaagggggtaacgggtccgtggggaacgggtttggggtccccttaggtaaagggtttntttaggaagtttaaggggtaaaagtttcggggttacgggttaacccctaagtttccgacccgtttagtcgggtacccgggtaccttcggttaaagggttaggaaaccggggtcctaacgttaccaaccccattaccgaacccgaagggaaccggtaaacccggaccggaccgaacggggtactacccctttcccggtagttaacccttacgttaaacccgaaaagtacgtaaacgtaggtcgttaaccggaaactaccggtacggaccggtaaccaaccgggtttccttaacgggtttaaatttaaccggtgggttaaaggtaaaacgggggtggtaaccgggttacgtttaacgggtttaacttaaaacg

SEQ ID NO: 353694 - DNA, 682 bp, Homo sapiens
  misc_feature: GZ8MTXP02IFGZQ.10.23.C01.1.454.CMB.2.raw
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (429)..(429): a, c, t, g, unknown or other
  misc_feature (429)..(429): n is a, c, g, or t
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggtattttccttttggctaattttaaaggtgtccagtgtgaagtgcagctggtggagtcgtgggggagcttggtacagcctggcaggtcctgagactctctgtcncagcctgnggtattcagtcttgatagaatatgccagtggacgtcgggtaccgactaaggttccgaggggacggccgtggggagtggggtccctacgtagggttataggtagtttaggggaaattgggtcgggtaacctagtttcgaccttagtggccggtacttcgnggttagggaacgggcctaagttccaaccgtatacccaaccgagacgaaccgaccggaccgaagggacgtcccttaccgtacgttaaccgtaccgttaaaccaaagttacgttaaaccgagtttaccgaaggtaaccgaccgttagggaaacggttaccgaaccgggtttccgtttaagtttacgttaaacggttggtttaagggtaaaacggtgggttaaccggtttacgttaacggggtttaaactaaacgg

SEQ ID NO: 353695 - DNA, 648 bp, Homo sapiens
  misc_feature: GZ8MTXP02JZ38X.10.23.C01.1.454.CMB.2.raw
  modified_base (270)..(270): a, c, t, g, unknown or other
  misc_feature (270)..(270): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactaagctggattttccttttggctattttaaaaggtgtccagtgtgaagtgcagctggtggagtcgtgggggaggcttggtacagccgtggcaggtccctgagactctcctgtgcagcctntggattcagctttgatgaatatcgccagtcggactggggtcccgactaaggttcccgaggggtaacgggcctaggggagtcggggtctccgagggttattgagtttcggaattggtcgggtaccagttcgcctagtggcgtactcgtgtaggaacgggtcgtattcccgacactaccgaaccgagacgaaccgaccggacgacgggacgtccctaccccgtattacccacctaaacgtaacgtaaccgaacgttacgtacgtaaacgacccgtacggacgggaaaccgacggtacccgttagtttacgttaaacttcggttaggtaaaggaagggtacgggtacgtaacggggtttacgtaaacgttaacgtttaaag

SEQ ID NO: 353696 - DNA, 897 bp, Homo sapiens
  misc_feature: GZ8MTXP02H7VA6.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagcgtgggtggagtcgtgggggaggtcgttggtacaggcctggctacggtccctgacgtacctctcctgtcgcacgtcctcgtgtattcagtcttagacttagaatatcgacctaggtcggaccggttcggggtaccccggtacgtaacgggttacccggaaggggggtaacggggtccgtaggggtaacgggttcggggttaccccgtacgtaggtttagttaggtaaggtttagggaaacggttaggggttcgggtaaacccgtagtttaccgggtaccctttaaggtacgggtacccggttaacgttcggtttaaggggtacgggggtaaaaccgggggttcccttaacgtttacccgaaacccgtaacgttacccggaaaaccgtacgggaaaaccggaaaccccgggtaaacccgggaacccgtaaaccgggggtacccgttacccctttacccccggggtttactaacccgtttaaccgtaaacccctaaaaagggttaccggaaaccgtttaacggtacccgttaacgggaaaccgtaacccgggttaggggtaaaacccgggtaccgttaacccgggggtttccttttaaacgggttaacgttttaacggtaaggggttaaacggttaaagggggtacgggttaaccggtttagggtttaaacgggttttaactttaaaaccggg

SEQ ID NO: 353697 - DNA, 813 bp, Homo sapiens
  misc_feature: GZ8MTXP02FQ364.10.23.C01.1.454.CMB.2.raw
  modified_base (251)..(251): a, c, t, g, unknown or other
  misc_feature (251)..(251): n is a, c, g, or t
tcagcatagtagtgcacgaccggtgctcgatttagtacacgtgattagggattgggggagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagcttggtacagccgtggcaggtcccngacgtctctcgtgtcgcacgtccgtcgtaggtactcgtacgttcttagatagaattagcgtactaggtcggtacggtcggggtcccggtaacgtaaccgggttaccgggaaacgggggtacggtccggtaggggtacgggttcggtacccgtacggttaggttagttaggtaggttaaggtaagtttacggggtaccgtaaacgtttaggttacccgtacgttacggtcgggtaccgttaacgttcggtaggggtaacgggaaccggggttctaaacgttcccaaaccgtacgtaaccccgacgaaaacgggaccggaaacccgaccggaaccggaacggggtaccttccccgttacccggtagtttaaccctaaccggtaaactaaacggtacgtaaaccgtacgttacggaacgtaaccgtaccggtaagggtaacccggaaccggttaccggttacccgttttaggtaaccctttagggtaaccggggttaaaggggttaaacggggtaacgggggtttacgtttaacccgggttaaaggttttaaccgtttaaaaacg

SEQ ID NO: 353698 - DNA, 730 bp, Homo sapiens
  misc_feature: GZ8MTXP02H2FTD.10.23.C01.1.454.CMB.2.raw
  modified_base (290)..(290): a, c, t, g, unknown or other
  misc_feature (290)..(290): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctattttaaaaggtgtcagtgtgaagtgcagctggtggagtcgtgggggagcttggtacagcctggcaggtcctgagctctcctgtcgcagcctgtggacttcagtctttgatgaatntcgccagtcgggacgtcggggtaccggacgtaaacggtttcccggaagggggtacggggacccgttgggggaacgggttcggggttaccctacggtaaggggtttattagggtagtttaggggaaatttgggtacgggttaaccctagtttcgacccttaggtcggtaccggtaaccttcggtaggttaacgggaaccgggggtaccctaacgtttacccgaacccgtatacccaacccggaggaaacgacccggaccgacccggagggtaccgtcccttaccccgtagttacctacccctaaaccgtaaaagtacggtaaacctacggttacgtaacggacgaacccgtaggaaacggaccctacgggttacccttagtaaccgtttacgtggtaacggtaaagggacgggtagtttaccggtaaggttttaaccaaag

SEQ ID NO: 353699 - DNA, 665 bp, Homo sapiens
  misc_feature: GZ8MTXP02IIYRV.10.23.C01.1.454.CMB.2.raw
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggaggtcgttggtacagcctggcaggtccctgacgactctctgtgcagcctntggattcagtctttgatgaatntcgcctagtcggacgtcggggtccggactaacggttccgaaggggaacgggtccgtagggacggttcgggtcctacgtaggttagttggtagtttaggaattaggttacgggtacctagtttcgacccttagtcgccggtacttcgtaggtacggaacgggcccgtaacttaccaacccgtatacccgaaccgaagaacgaccggaaaccggccgaacgggtaccgcccttacccgtagtacctaccgtaacctaaagtacgaaactagtacgtagaacgaccgtaggaacgtaccgacggttcctttaacgttacttacggtaaggttagtaacggtacgggtacgttacggtaacgggtttactaaacg

SEQ ID NO: 353700 - DNA, 782 bp, Homo sapiens
  misc_feature: GZ8MTXP02JFIBH.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggacttaattttaaaaggtgtccagtgtgaagtgcagctggtggagtcggtgggggagtcgttggtacagccgtggctacggtccctgacgtactccgtcctgtcgcacgcctcgtggtacttcgagttctttagatagtaaatgtcgacctagtcggacgtcgggtaccgacgtaacggtccggaaggggacggtccgtgggaaggtcggttacctacggtagttattaggtacgttagggaaattcggggtacgtaacctagttaccgtaccgtagtcgtacggtaacttcggaggttaacggacggggtcctaacttaccacctaacgtaccaaaccgagaaccgaacggaccgacccggtaaagaccgtacccgtttccgtaagtaaacccgttccaaaaccgtaaaagtaccggtaaaactacgttaccgaaacggtaaaaccggtccggttaaacggaaacccgggggttaaaccctacccggggtttacctttaaaacggggtttactttaaaacgggttaagggttaaaacgggttaaaaacgggggttacggggttaaaaccgtttacggggtttaaaacccggggtttactttaaaaaaccgg

SEQ ID NO: 353701 - DNA, 722 bp, Homo sapiens
  misc_feature: GZ8MTXP02IPO31.10.23.C01.1.454.CMB.2.raw
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggtattttcctttggctaattttaaaaggtgtcagtgtgaagtgcagcgtggtggagtcgtgggggaggtcgttaggtacagccgtgggctacgggtccctggacgactccgtccgtggtacgccacgccctcgtggacttcgagtacgttttggataggaaatagtcgtccgagtcggacgtggggtccgacgtaaggttcccggaaggggaacggccgttagggacggttgggtcccctaggtaggttagtggaacgtttagggaaaattgggtacgtaaccttagttcgcccttaagtcgtacggtacttcggtaggttaacggaacggggttccctaagtttacccgaacctacgtaccgaccgaaaggacgaaaccggccgaaccggaacgtcgtacccgttaccctaggttaacctaccgtaaccctaaaggtaacaaacggtacgttacgagggtaaccaccgggttaggaaacggtaccggtaacccggtagttacggttaactacgttaacggtaggttaaacggagggttagtaccggttaaggtttaactaaaag

SEQ ID NO: 353702 - DNA, 628 bp, Homo sapiens
  misc_feature: GZ8MTXP02FJU3Y.10.23.C01.1.454.CMB.2.raw
  modified_base (183)..(183): a, c, t, g, unknown or other
  misc_feature (183)..(183): n is a, c, g, or t
  modified_base (229)..(229): a, c, t, g, unknown or other
  misc_feature (229)..(229): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
tcagcatagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttcctttggctatttaaaggtntccagtgtgaagtgcagctggtggagtcgtgggggagcttggtacnggcctgggcaggtccctgagacctctcctgtgcagcctcgtggattcagtctttgatgaatntgccatggacgtgggtccganaggtccgaagggacgggctaggggagtggtccncgtaggtattggagtttaggaaacttggtacgggtaccctaagttcgtacccgttagtcgggaccgggtacgtccgtaggttacggaaaggggtacccgtaacgttctaacccgactaccaaccgagaacgaaccggaaccgccgagggacgcccgtacccgtactactcctaacaaacgtacgaacagtctagacgaccgtcgtaacggaccgtacggtaccgttacgtacttacgtaagttaggtaacggaggggtgtacggttaacgggtttactaaacg

SEQ ID NO: 353703 - DNA, 517 bp, Homo sapiens
  misc_feature: GZ8MTXP01DBA7S.25.46.E02.1.454.CMB.2.raw
  modified_base (226)..(226): a, c, t, g, unknown or other
  misc_feature (226)..(226): n is a, c, g, or t
  modified_base (495)..(495): a, c, t, g, unknown or other
  misc_feature (495)..(495): n is a, c, g, or t
tcagactgtacagtcacgaccggtgctcgatttagactcatctacagggaaaggggcagcaagatggtgttgcagacccaggtcttcatttctctgttgctctggatctctgttctgactacaggggcctacggggacatcgtgatgacccagtctccagactcgttggctgtgtctctgggcgagagggccaccgtcaactgcaagtccagccagagtcttttanacagtgccgacaataagaactacttagcttggtatcagcagaagccaggacagcctctaagctgctcatttcctgggcatccgtacccgggatccggggtcctgaccgattccagtggcaggcgggtctgggcagtactttcactctcatcatcagcggcctgcaactgacgatgtgtcggtttattacgtgtcagcaacactatcttactccgtcgtacgttcggccaagggaaccaaggttagtaaattcgaagcgttaacgttggnggctgcaccattctcgttcttc

SEQ ID NO: 353704 - DNA, 525 bp, Homo sapiens
  misc_feature: GZ8MTXP01DHRHH.25.46.E02.1.454.CMB.2.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
tcagactgtacagtcacgaccggtgctcgatttagactcatctacagggaaagggggcagcaagatggtgttgcagacccaggtcttcatttctctgttgctctggatctctgttctgactacaggggccgacggggacatcgtgatgacccagtctccagactcgttggctgtgtctctgggcgagagggcccaccgtcaactgcaagtccagccagagttctttanacagtgccgaacaataagaactacttagcttggtatcagcagaagccaggacagcctctaagctgctcatttccngggcatccgtacccgggaatcccggggtcctgaccgattccagtggcagcgggtactgggaacagatttcactctcatcatcagcggctgcaacctgacgatgtgcgtttatactggctagcaacactatcttactcctcggtacgttcgaccaagggaaccaaggttagtaacttacgaaacgcgaacgttgttaggctcgcacccattcgtgttcttaac

SEQ ID NO: 353705 - DNA, 496 bp, Homo sapiens
  misc_feature: GZ8MTXP01BR46E.25.46.E02.1.454.CMB.2.raw
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (298)..(298): a, c, t, g, unknown or other
  misc_feature (298)..(298): n is a, c, g, or t
  modified_base (348)..(348): a, c, t, g, unknown or other
  misc_feature (348)..(348): n is a, c, g, or t
  modified_base (469)..(469): a, c, t, g, unknown or other
  misc_feature (469)..(469): n is a, c, g, or t
tcagactgtacagtcacgaccggtgctcgatttagactcatctacagggaaaggggcagcaagatggtgttgcagacccaggtcttcatttctctgttgctctggatctctgttctgactacaggggccgacgggacatcgtgatgacccagtctccagactcgttggctgtgtctctgggcgagagggccaccgtcaactgcaagtccagccagagtctttanacagtgccganaataagaactacttagcttggtatcagcagaagccaggacagcctctaagctgctcatttccnggcatcctacccgggaatccgggtcctgaccgattccagtgcagcggtcngggcagtatttcactctcatcatcagcgctgcaactgacatgtgcgtttatacgtggtcagcaaacactatcttactccgtcgtacgttcggaccaagggaaccaaggactgttggctgcnccatctgtcttcacttcttccgctaac

SEQ ID NO: 353706 - DNA, 566 bp, Homo sapiens
  misc_feature: GZ8MTXP01A926S.25.46.E02.1.454.CMB.2.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (332)..(332): a, c, t, g, unknown or other
  misc_feature (332)..(332): n is a, c, g, or t
tcagactgtacagtcacgaccggtgctcgatttagactcatctacagggaaagggggcagcaagatggtgttgcagacccaggtcttcatttctctgttgctctggatctctgttctgactacgaggggccgacggggacatcgtgatgacccagtctccagactcgttggctgtgtctctgggcgagagggccaccgtcaactgcaagtccagccagagttcttttanacagtgccgaacaataagaactacttagcttggtatcagcagaagccaggacagcctctaagctgctcatttccnggcatccgtacccgggatcccgggtccngaccgattcccaggtggcaggcggtctgggaacagtattcactctcatcatcagcggcctagcaaccgtgacgagtgtaggtcggtttaattacgtgtacgagtaccaaactactactccttaactcccgtacggtaccgttaccggaccgtaaacgggaaccgtaaaggttaagaacttcgaaagtaccgaacgttggttcggaactgaaccacctattcgtcgttcttcccg

SEQ ID NO: 353707 - DNA, 600 bp, Homo sapiens
  misc_feature: GZ8MTXP01BMTPF.25.46.E02.1.454.CMB.2.raw
  modified_base (231)..(231): a, c, t, g, unknown or other
  misc_feature (231)..(231): n is a, c, g, or t
  modified_base (312)..(312): a, c, t, g, unknown or other
  misc_feature (312)..(312): n is a, c, g, or t
tcagactgtacagtcacgaccggtgctcgatttagactcatctacagggaaagggggcagcaagatggtgttgcagacccaggtcttcatttctctgttgctctggatctctgttctgactacaggggccgacggggacatcgtgatgacccagtctccagactcgttggctgtgtctcgtgggcgagagggccaccgtcaactgacaagtccagccagtagttcttttanacagtgaccaacaaataagaacttacttagcttggtatcagcagacgccaaggacacgcctctaagctgctctatttccgnggcagtcccgtacccgggtatcccggggtcctaggaccgtattccgaggtggaccgaggccggttacgacgggtaactagtactttccaccgttctactatccacgtcgacggccgtcctagaccctaaccgtgacgtagtggttcggtacgtttatacgtggtacacgacctaacgtacctacttccttaccgtccgtacggtacgtccggaccaaggaacctaagttataacgttcgaacgtgacgttggttacgcctagtccgaactcgttctcgttcttaaccg

SEQ ID NO: 353708 - DNA, 722 bp, Homo sapiens
  misc_feature: GZ8MTXP01DR4B5.25.46.E02.1.454.CMB.2.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
tcagactgtacagtcacgaccggtgctcgatttagactcatctacagggaaagggggcagcaagatggtgttgcagacccaggtcttcatttctctgttgctctggatctctgttctgactacgaggggccgacggggacatcgtgatgacccagtctccagactcgttggctgtgtctcgtgggcaggagggcccacgtcaactgcaagtccagccagtagttctttanacagtgaccgaacaaataaagaacttacttagcttggtatcagacagaacgccaaggacagcctactaagctgcctnactttccgtgggacctagttacccgtaaccccgggggtaagttcccccgggggtaccctggaacccgtatttaccccgagggttcgggacgtacgggtccgggggtaacttacgggggaacctaggtacttttaccactctacaacttcaacgttcgaacggcccgggtacctacggaccctaaaccgtacggtaaccggtaagttcggtacggggttcggtttaattaacccgtggggttaccaacggtacctaaacgtaccttaacttacccgttacgttcccgtacggtaccgttccggaaccggtaaacgggaacccgtaaaggttaaccgtaaagttacgaaacggtcggttaaaacgttcggttacgggtctacgaaccgtaaccctagttcctcgttccgtttaaccc

SEQ ID NO: 353709 - DNA, 508 bp, Homo sapiens
  misc_feature: GZ8MTXP01CN7R8.25.46.E02.1.454.CMB.2.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
  modified_base (495)..(498): a, c, t, g, unknown or other
  misc_feature (495)..(498): n is a, c, g, or t
  modified_base (500)..(508): a, c, t, g, unknown or other
  misc_feature (500)..(508): n is a, c, g, or t
tcagactgtacagtcacgaccggtgctcgatttagactcatctacagggaaaggggctggagtggctgggagttacttggtctgacagacaaatgacatatcacgcggagtccgtgaggggccgattcaccatctccagggacaattccaagagaaccctctatctgcaaaatgaacaacttgagagtcgaggatacggtccgttttattactgngcgacctnaggagtggctaggaaaagtcgtagtctctacttcccgtcgaccttcggtcggggccacgggcctacccgtggccaccgtcctcctcacgtcctaccgaccaacggccctagtcccggtcctcccccgtcggccncccctcgtcctccgacggacncctaccgtcggtcgggggccccacggcggccgtcccgtgggcctcgtccgtgggtaccaacggtacctacgtccacgtcgttacagtcgtggcgggcggcgtggcgaaggtcagtannnngnnnnnnnnn

SEQ ID NO: 353710 - DNA, 426 bp, Homo sapiens
  misc_feature: GZ8MTXP02H08NF.25.46.E02.1.454.CMB.2.raw
  modified_base (336)..(336): a, c, t, g, unknown or other
  misc_feature (336)..(336): n is a, c, g, or t
  modified_base (420)..(426): a, c, t, g, unknown or other
  misc_feature (420)..(426): n is a, c, g, or t
tcagactgtacagtcacgaccggtgctcgatttagactcatctacagggaaagggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttatactgtgcgacctcaggagtggctggaaaaagtcgtagtctcattcccgtcgacctctgggccagggcaccctggtcaccgtctcctcagctccaccaaggcccatcggtctcccctgcgcctgctccaggngcacctctggggccacagcgccctggctgcctggtcaaggctacttccactgtacagtctgagcgggctggcaaggcgcatagnnnnnnn

SEQ ID NO: 353711 - DNA, 499 bp, Homo sapiens
  misc_feature: GZ8MTXP02JCA6G.25.46.E02.1.454.CMB.2.raw
  modified_base (224)..(224): a, c, t, g, unknown or other
  misc_feature (224)..(224): n is a, c, g, or t
tcagactgtacagtcacgaccggtgctcgatttagactcatctacagggaagggcagcaagatggtgttgcagacccaggtcttcatttctctgttgctctggatctctgttctgactacaggggccgacggggacatcgtgatgacccagtctccagactcgttggctgtgtctctgggcgagagggccaccgtcaactgcaagtccagccagagtcttttanacagtgccgacaataagaactacttagcttggtatcagcagaagccaggacagcctcctaagctgctcatttcctggcatctacccgggaatccggggtcctgaccgattccagtgcagcggtctgggcagatttcactctcatcatcagcggcctgcaacctgacgatgtgcgtttatactgtcagcaacactatcttactcctcggtacgttcgccaagggtaccaaggtagaaacttcaagtcgaactgtaggctgacaccatctcgtcttc

SEQ ID NO: 353712 - DNA, 430 bp, Homo sapiens
  misc_feature: GZ8MTXP02JMKY9.25.46.E02.1.454.CMB.2.raw
  modified_base (424)..(424): a, c, t, g, unknown or other
  misc_feature (424)..(424): n is a, c, g, or t
  modified_base (426)..(430): a, c, t, g, unknown or other
  misc_feature (426)..(430): n is a, c, g, or t
tcagactgtacagtcacgaccggtgctcgatttagactcatctacagggaaagggtctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctaggaaaaagtcgtagtctcattcccgtcgacctctggggccaggggcaccctggtcaccgtctcctcagcttccaccaagggcccatcggtctcccctggcgccctgctccaggagcacctctggggccacagcgccctgggctgcctggtcaaggactacttcactgtacagtctgagcgggctgcaaggcgnannnnn

SEQ ID NO: 353713 - DNA, 553 bp, Homo sapiens
  misc_feature: GZ8MTXP02JVGAZ.25.46.E02.1.454.CMB.2.raw
  modified_base (225)..(225): a, c, t, g, unknown or other
  misc_feature (225)..(225): n is a, c, g, or t
  modified_base (299)..(299): a, c, t, g, unknown or other
  misc_feature (299)..(299): n is a, c, g, or t
  modified_base (491)..(491): a, c, t, g, unknown or other
  misc_feature (491)..(491): n is a, c, g, or t
tcagactgtacagtcacgaccggtgctcgatttagactcatctacagggaaaggggcagcaagatggtgttgcagacccaggtcttcatttctctgttgctctggatctctgttctgactacaggggccgacggggacatcgtgatgacccagtctccagactcgttggctgtgtctctgggcgagagggccaccgtcaactgcaagtccagccagagtctttanacagtgccgacaataagactacttagcttggtatcagcagaagccaggacagcctcctaagctgctcatttccnggcatcgtacccgggatcccggggtcctgaccgtattcccgagtcggcaggtcgggtctggggccaaggtctttccacttctcactcactcagccggcctgccaactggacgtagtgtggtcgtttatacctgtctagacaactactatccttactccgtcggacgttcggaccgtaagggaccaaaggtanaacgtcgaaacgacgtaaccgtagtggaactcggaccacctacgtccgtacgttccttaccg

SEQ ID NO: 353714 - DNA, 547 bp, Homo sapiens
  misc_feature: GZ8MTXP02HSMP2.25.46.E02.1.454.CMB.2.raw
  modified_base (227)..(227): a, c, t, g, unknown or other
  misc_feature (227)..(227): n is a, c, g, or t
  modified_base (378)..(378): a, c, t, g, unknown or other
  misc_feature (378)..(378): n is a, c, g, or t
  modified_base (422)..(422): a, c, t, g, unknown or other
  misc_feature (422)..(422): n is a, c, g, or t
tcagactgtacagtcacgaccggtgctcgatttagactcatctacagggaaagggggcagcaagatggtgttgcagacccaggtcttcatttctctgttgctctggatctctgttctgactacaggggccgacggggacatcgtgatgacccagtctccagactcgttggctgtgtctctgggcgagagggccaccgtcaactgcaagtccagccagagtcttttancaagtgccgacaataagaactacttagcttggtatcagcagaagccaggacagcctacctaagctgctcatttccgtggcatccgtacccgggatcccggggtcctgaccgattcagtcgcaggcgggtctgggactagactttcactccncatcatcacgcgctgcaactgacgatgtcgtcgtttattacgtntacagtacaacactactaccttactccgtcgtacgttccgaccgaaagggaaccgaaggtaagaacttacgaaacgtacgaaactggtacggaacttcgactacctacttcgtcgtttccttacg

SEQ ID NO: 353715 - DNA, 766 bp, Homo sapiens
  misc_feature: GZ8MTXP02GNKOT.25.46.E02.1.454.CMB.2.raw
  modified_base (232)..(232): a, c, t, g, unknown or other
  misc_feature (232)..(232): n is a, c, g, or t
tcagactgtacagtcacgaccggtgctcgatttagactcatctacagggaaagggggcagcaagatggtgttgcagacccaggtcttcatttctctgttgctctggatctctgttctgactacgaggggccgacggggacatcgtgatgacccagtctccagactcgttggctgtgtctcgtgggcgaggacgggccaccgtcaactgacaagtccagccagtgttctttanacagtcgccgaacaataacgaacttacttagcttggtatcgagacaaggaacgccaaggtaccacggtcccctaccgtaaggcctggtccttacgtacttttcccggagggcctaacgttaccccggtaaaccccggggtaacgtttccccccgggggtacccttagggaaaccccgttatttaccccgacggggttcgggacctaacggggtcccggggtttacggtacggggtacctacgggttaacctttttaccaacccgtttcctaccgaacttaccaacgttacgaccgggtcccgggtacccttacggacccgtaaccgttacggaaccgttaggttcgggttacgggttacgggttttacttaacggtggtacaacgtacctaaacttacttacttacccttaccgtcggtaccggtacggttaccggacgaaacgggtaacgtaaggtaagtaacgttacgaaacgtacggtaaccgtgggtacgtccgtcggtaacctacctacgttacgtcgtttacctttcc

SEQ ID NO: 353716 - DNA, 576 bp, Homo sapiens
  misc_feature: GZ8MTXP02HNUX3.25.46.E02.1.454.CMB.2.raw
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
tcagactgtacagtcacgaccggtgctcgatttagactcatctacagggaaaggggcagcaagatggtgttgcagacccaggtcttcatttctctgttgctctggatctctgttctgactacgaggggccgacggggacatcgtgatcgacccagtctccagactcgttggctgtgtctcgtgggacgagacgggccaccgtcaactgacaagtccagccagtattcttttanacagtnaccgaanaataagactacttagcttgtatcagcagaacgccagacagcctactaagctgcctntattccgtggcatccgtaacccgggatcccggggtcctagaccgtattcccgagtcgcgaggccgggtgtagggacctaggtattccacttcacaattccatcagcgtccacgacaccgtgacgtagtggttacggtacgtttattaccggtgtacacaactaactacgtacttacctacgtccgtacggtacgtaccgaacgaacggtacgaagtacaactacgaacgacgtaacgtagtcgaacgtacgacctactacttccgtacttactc

SEQ ID NO: 353717 - DNA, 682 bp, Homo sapiens
  misc_feature: GZ8MTXP02IM711.25.46.E02.1.454.CMB.2.raw
  modified_base (234)..(234): a, c, t, g, unknown or other
  misc_feature (234)..(234): n is a, c, g, or t
  modified_base (324)..(324): a, c, t, g, unknown or other
  misc_feature (324)..(324): n is a, c, g, or t
  modified_base (375)..(375): a, c, t, g, unknown or other
  misc_feature (375)..(375): n is a, c, g, or t
tcagactgtacagtcacgaccggtgctcgatttagactcatctacagggaaagggggcagcaagatggtgttgcagacccaggtcttcatttctctgttgctctggatctctgttctgactacgaggggccgacggggacatcgtgatgacccagtctccagactcgttggctgtgtctcgtgggcgaggacgggccaccgtcaactgcaagtccagccagtagttcttttaanacagtgaccgaactaaataagaactacttagcttggtatcagacaagaacgccaaggaccacgccctacctaagctgcttacatttccgnggactacgtacccgtaccccggggtaagtccccggggtacctggacccgtnttcccgaggtcgacgaggtcgggtctggggactgtactttccgaccttctacactcactcgacggccgcctgaccaacgtcgacgtagttcggtacgggttacggttttattacgtagtacgaacgtactaacctaacttacttccgttaaccgtcccgttaccgggtaccggtttacccgggaacccgaaaacggggttaaacccgtaaagggttaaacgtaaccgtttaaaacgaaccggtacgtaaaccggttggttaccggcgttacggaccgtacccttaattcctttacgttcctttaccg

SEQ ID NO: 353718 - DNA, 559 bp, Homo sapiens
  misc_feature: GZ8MTXP01AE81V.25.75.G09.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (459)..(459): a, c, t, g, unknown or other
  misc_feature (459)..(459): n is a, c, g, or t
  modified_base (487)..(487): a, c, t, g, unknown or other
  misc_feature (487)..(487): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggngcgccaggcccccganaagggcttgagtggatggggatggatcaacactgccaaatggtaaatgacaaactatcggaccaagaaaactccccgaaaggggccaaggagtccaacggttttaacaggggacacaactccgacgagtacaggctacagtggacctgagtgcctggtatcgtgaagacaacggntagtgtattacgtgtgtagacgataagnggttgggacgcgtcgtccgttcgccgttacggtcgggcggaacgggccggtcggttccgtccgttccgtccg

SEQ ID NO: 353719 - DNA, 585 bp, Homo sapiens
  misc_feature: GZ8MTXP01DX023.25.75.G09.1.454.CMB.2.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggcttctggatacaccttcgcaagtcatgctcttcattgggncgccacggcccccgganagggcttgagtggatgggatggatcaacnctgaccaagtggtaatgacaaactatcgaccaagaaactcccgaaagggcaaggacgtactaacgtttaacgagggacacgactccgacgaagtacgaggctaacgatcggacctggagtcgctaggtatcggtagaacgacacggctaagtgttaattagtgtgtagagtacgtaagtggttgggggattcgttcgtcccgttacgaccgttagggttcgggggacccgtaagggggtcccctggggttacctcccggttcgttccccg

SEQ ID NO: 353720 - DNA, 675 bp, Homo sapiens
  misc_feature: GZ8MTXP01CO2MP.25.75.G09.1.454.CMB.2.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
tcagactgtacagtcacgaccggtgctcgatttagtatagacatcagggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattggncgccaggcccccganaggcttgagtggatgggatggatcaacactgaccaaatggtaaatgacaaactatgacccaagaaaactccccgaaaggggaccaaggacgtaccgtaacggtttttaacgacggggaaccacgaacttccccggacgaaggttaaccgagggacccttaaacgtaacgtacggtaccgtacggtacggtacgggtaccgttacggttacgttacgggttaacggtaaacggtaaccgtaaccggtacgttaagttacgtttaagtttaacgttagttagtagtaagtaagtaacgtagggttagggtacggttcgtccgtccgttccgttaccgttacggttaacgggtaccggtaaccgggtcccggtcggttccgtaacccgttccgtccg

SEQ ID NO: 353721 - DNA, 565 bp, Homo sapiens
  misc_feature: GZ8MTXP01D2THP.25.75.G09.1.454.CMB.2.raw
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (342)..(342): a, c, t, g, unknown or other
  misc_feature (342)..(342): n is a, c, g, or t
  modified_base (453)..(453): a, c, t, g, unknown or other
  misc_feature (453)..(453): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggcttctggatacaccttcgcaagtcatgctnttcattgggncgccacggcccccgganaagggcttgagtggatgggatggatcaacactgaccaatggtaaatgacaaactcncgaccaagaaactcccgaaagggcaagagtactacgtttacagggacactactccgacgagtacaggctacagtcgacctgagtggcctaggtatggtagaagacacggtntatgttattagtgtgtagacgattaagagggttcgggacggcgtccgtccgttcgttacgttacggttcgggccggaacgggaccggtccggttcgtccgttccgttccccg

SEQ ID NO: 353722 - DNA, 539 bp, Homo sapiens
  misc_feature: GZ8MTXP01C8L6R.25.75.G09.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
  modified_base (509)..(509): a, c, t, g, unknown or other
  misc_feature (509)..(509): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgccaggcccccgganaagggcttgagtggatgggatggatcaaacactgccaaatggtaaatgacaaaactatggaccaagaaactccccgaaaggggccaagagtcaacgtttacagggacacatccgcgagtacaggctacatggacctgagngcctggtatcgtgaaagacacggctatgtattacngtgtgagataacgnggttggggancgtcgtccttcgccagttcggggccnggggacccctggttcctaaccgttctcccg

SEQ ID NO: 353723 - DNA, 535 bp, Homo sapiens
  misc_feature: GZ8MTXP01CBKV9.25.75.G09.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgccaggcccccgganagggcttgagtggatgggatggatcaacnctgccaatggtaaatgacaaactactgaccagaaactccccgaaagggccaagagtcacgtttactagggacacactccgngagtacaggctanatggactgagtgctggtatcgtgaagacacggctaagtgtattactgtgtgagataacgaggttggggagcgtacgtccttcgccgagttcgggggccaaggggtccctggttccaaccggttctcccg

SEQ ID NO: 353724 - DNA, 533 bp, Homo sapiens
  misc_feature: GZ8MTXP01D3LYE.25.75.G09.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (441)..(441): a, c, t, g, unknown or other
  misc_feature (441)..(441): n is a, c, g, or t
  modified_base (476)..(476): a, c, t, g, unknown or other
  misc_feature (476)..(476): n is a, c, g, or t
  modified_base (531)..(531): a, c, t, g, unknown or other
  misc_feature (531)..(531): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgccaggcccccgganaagggcttgagtggatgggatggatcaaacactgccaaatggtaaatgacaaaactatcgaccaagaaatccccaaagggcaagagtcaacgtttacagggacacatccgagagtacaggctacatggactgagtgctggtatcgtagaagacacggntaatgtattatgtgtgagataacgaggttggggancgtcgtccttcgccagttgggggccaaggggtccctgggttcctaaccgtttccncg

SEQ ID NO: 353725 - DNA, 551 bp, Homo sapiens
  misc_feature: GZ8MTXP01A4M5N.25.75.G09.1.454.CMB.2.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (478)..(478): a, c, t, g, unknown or other
  misc_feature (478)..(478): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgccaggcccccganaagggcttgagtggatgggatggatcaacactgccaatggtaaatgacaaactactgaccaagaaactcccgaaaggggcaagagtcacgtttacagggacacactccgagagtacaggctacgatggacctgagtgcctggtatcgtgaagacacggctagtgtattactgtgtgagctaagaggttgggggancgtcgtccgttcgccgttaggttcgggggcccgtaacgggggaccctcgggttacctaacccggttcctcccg

SEQ ID NO: 353726 - DNA, 537 bp, Homo sapiens
  misc_feature: GZ8MTXP01CJF56.25.75.G09.1.454.CMB.2.raw
  modified_base (206)..(206): a, c, t, g, unknown or other
  misc_feature (206)..(206): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
  modified_base (478)..(478): a, c, t, g, unknown or other
  misc_feature (478)..(478): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagaagcctggggcctnagtgaaggtttcctgcaaggcttctggatacaccttcgcaagtcatgctcttcattgggncgccaggcccccganaagggcttgagtggatgggatggatcaacnctgccaatggtaatgacaaactactgaccaagaaactcccgaaaggggcaaggagtacacgtttacagggacacatccgagagtacaggctacgatggacctgagtgcctggtatcgtgaagacacggctatgttattacgtgtgtgacgataacgaggttggggancgtacgtccttcgccagttggggaccaagggggtccctgggttccaacccggttctccc

SEQ ID NO: 353727 - DNA, 594 bp, Homo sapiens
  misc_feature: GZ8MTXP01DGX0O.25.75.G09.1.454.CMB.2.raw
  modified_base (208)..(208): a, c, t, g, unknown or other
  misc_feature (208)..(208): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
tcagactgtacagtcacgaccggtgctcgatttagtatagacatcagggacccaacaaccacatccctcctcagaagcccccagagcacaactcctcaccatggactggacctggaggatccttctttttggtggcagcagccacaggtgcccactcccaggtccagcttgtgcagtctggggctgaggtgaagaagcctggggcctnagtgaaggtttcctgcaaggcttctggatacaccttcgcaagtcatgctcttcattgggncgccaggcccccganaggcttgagtgatgggatggatcaanactgaccaaatggtaatgacaaaactncgaccaagaaaactcccgaaagggccaaggacgtcaacgtttacaggggacacatccgacgaagtacgaggctaacagtgggacctggagtcgggccttagggtatcggtagaaacgacaacgggctagtgttaattacgtgtgtagaagtacgtaagtagggttgggtacttccgttccgtccgttacgttacgttacgggttccggggacccgtaacggggtccccgtcgggttaccctaacccggttccgtcccg

SEQ ID NO: 353728 - DNA, 531 bp, Homo sapiens
  misc_feature: GZ8MTXP01ESCYK.25.75.G09.1.454.CMB.2.raw
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (343)..(343): a, c, t, g, unknown or other
  misc_feature (343)..(343): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggngcgccacggcccccgganaagggcttggagtggatgggatggatcgaacactgaccaagtggtaaatgacaaactntgaccaagaaactcccgaaagggcaaggatcgaacgtttactagggacacatccgagagtacaggctacatggacctgagtggcctaggtatcggtagaagacgacggctagtgtattactgtgtgagataagagttgggancgtcgtcncgcagttggggcgaacgggcctggttctccgttctccg

SEQ ID NO: 353729 - DNA, 564 bp, Homo sapiens
  misc_feature: GZ8MTXP01AR64L.25.75.G09.1.454.CMB.2.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
  modified_base (510)..(510): a, c, t, g, unknown or other
  misc_feature (510)..(510): n is a, c, g, or t
tcagactgtacagtcacgaccggtgctcgatttagtatagacatcaggggacccaacaaccacatccctcctcagaagccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgccacggccccganaaggcttgagtggatgggatggatcaacnctgccaagtggtaatgacaaactntcgaccaagaaactcccgaagggccaagagtacacgtttacgagggacacatccgagagtacaggctacagtcggaacctgagtcggactgggtatcggtagaacgtacgaccggtattagttcgtatttaacgtgttggttacgagtataagagggttggggattcgtcgtccncgccgttaggttcggggcaacgggggtaccctgggttacctccggttcctcccg

SEQ ID NO: 353730 - DNA, 554 bp, Homo sapiens
  misc_feature: GZ8MTXP01BRL4Z.25.75.G09.1.454.CMB.2.raw
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
tcagactgtacagtcacgaccggtgctcgatttagtatagacatcagggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggngcgccacggccccccgganaagggcttgagtggagtggatggatcaacnctgcctaagtggtaaatgacaaaactatcgaccaagaaactcccgaaagggccaagagtccacgtttacaaggggacacatcccgngaagtacaggctanagtggacctgagtgctaggtatcggtgaaagcacggtctatgtattatgtgtagagataagagttgggacgcgtcgtccgttcgaccttaggttcggggccaacggggtacccgtcggttcctaacccgttcgtcccg

SEQ ID NO: 353731 - DNA, 584 bp, Homo sapiens
  misc_feature: GZ8MTXP01DZHF2.25.75.G09.1.454.CMB.2.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (341)..(341): a, c, t, g, unknown or other
  misc_feature (341)..(341): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggcttctggatacaccttcgcaagtcatgctcttcattgggncgccacggcccccgganaaggcttgagtggatggatggatcaacactgaccaatggtaatgacaaaactacncgaccaagaaactccccgaaaggggccaaggacgtccaacggttttaacgaggggacacactcccgacgaagtacgaggctaacgagtcggaccttggagtcggcctgggtactcggtagaaggacacggtctagtgttattacgtgtgtgagataagaggttgggggattcgtccgtccgttacgccgttagttcgggggacccgaacgggggtaccctgggttcctaaccggttctccccg

SEQ ID NO: 353732 - DNA, 624 bp, Homo sapiens
  misc_feature: GZ8MTXP01CT6N5.25.75.G09.1.454.CMB.2.raw
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggctctggatacaccttcgcaagtcatgctcttcattgggngcgccaggcccccgganaagggcttgagtggatgggatggatcaacactgccaagtggtaatgacaaactactgaccagaaaactccccgaaagggaccaagacgtacctaacggttttacaggggactacgactcccgacgtaacgtaccgagggtaccttaacgattacgggaccttggaacggtcggaccgttgggtaactcggtaggaaacgaccgaacgggtctaagtgttatttacgtgttgtagtaagtagtaacgtagggttgggggtacgcgttccgtccgttacgcccgttaggttcgggggacccgtaacggggtacccttgggttaccctaaccgttccgtcccg

SEQ ID NO: 353733 - DNA, 597 bp, Homo sapiens
  misc_feature: GZ8MTXP01CVII6.25.75.G09.1.454.CMB.2.raw
  modified_base (208)..(208): a, c, t, g, unknown or other
  misc_feature (208)..(208): n is a, c, g, or t
  modified_base (267)..(267): a, c, t, g, unknown or other
  misc_feature (267)..(267): n is a, c, g, or t
  modified_base (508)..(508): a, c, t, g, unknown or other
  misc_feature (508)..(508): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctnagtgaaggttcctgcaaggcttctggatacaccttcgcaagtcatgctcttcattgggncgccgacggcccccggagaagggcttgagtggatgggatggatcaacacgtgaccaagtggtaatgactaaactactacgaccaagaaactccccgaaggggcaaggacgtaccgtaacgtttaacgacgggacacacgtccgacgagtacgaggctaacagtcggactgagtggaccttgggtactcggtaggaacgacgacggtcttagtcgttattaacgtggtgtagagtactaagngggttggggagttcgtcgtccttacggacgttacggttcgggggacccgtaacggggaccctcgggttccctaaccggttcctaacccg

SEQ ID NO: 353734 - DNA, 590 bp, Homo sapiens
  misc_feature: GZ8MTXP01ARHYL.25.75.G09.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (510)..(510): a, c, t, g, unknown or other
  misc_feature (510)..(510): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggncgccacggcccccganaagggcttgagtggatgggatggatcaacacgtgaccaagtggtaaatgacaaactactcgaccaagaaactccccgaaaggggaccaaggagtacctaacggttttaacgacggggacaacgactcccgacgtaagtacgaggctaacgacgttggacctggaacgttcggccttgggtactcgtagaacgtacacggtctagtgtattactgtgtgagataacgnggttggggacttcgtcgtccttcggaccttaggttcggggccgtaacggggaccctcggttccgtaacccgttcgtcccg

SEQ ID NO: 353735 - DNA, 663 bp, Homo sapiens
  misc_feature: GZ8MTXP01CRZRL.25.75.G09.1.454.CMB.2.raw
  modified_base (275)..(275): a, c, t, g, unknown or other
  misc_feature (275)..(275): n is a, c, g, or t
tcagactgtacagtcacgaccggtgctcgatttagtatagacatcaggggacccaacaaccacatccctcctcagaagccccagagcacaactcctcaccatggactggacctggaggatcctctttttggtggcagcagccacaggtgcccactcccaggtccagcttgtgcagtcgtggggctgaggtgaagaagccgtggggcctcgagtgtaaggtttcctgcaaggtcttctggatacaccttcgcaagtcatgcttcttcagttgggcncgccgacgggcccccggaagaagggtcttgagtggagtgggatggatcgaacactgaccaagtggtaaatcgactaaactctacgaccaagaaacctccccgaaaggggacaaggacgttaccgtaaacgttttacgacgggaacctacgacgtaccgacgacgtaacgaggacttacgagtacggaccgtggacgtcggtaccgttggtaatcggtaggaaacgtacgaacggtcttaagtgttaatttacgtggttagtaggaagtaacgtaaggtagggttgggggacttccgttaccggtcccgttaccggaccgttacggggttaaccggggcccggtaacgggggtaccccgttgggttacccgtaacccggttcctccccg

SEQ ID NO: 353736 - DNA, 561 bp, Homo sapiens
  misc_feature: GZ8MTXP01AWU0L.25.75.G09.1.454.CMB.2.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (466)..(466): a, c, t, g, unknown or other
  misc_feature (466)..(466): n is a, c, g, or t
  modified_base (505)..(505): a, c, t, g, unknown or other
  misc_feature (505)..(505): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagccgtggggcctcagtgaaggtttcctgcaaggcttctggatacaccttcgcaagtcatgctcttcattgggncgccaggccccgganaaggcttgagtggatgggatggatcaacactgaccaagtggtaaatgacaaactatgaccaagaaaactccccgaaaggggcaaggacgtactaacggtttacgtaaggggaccaacgtactcccgacgaacgtacaggactaacagtggacctgagtgctaggtatcgtagaagtacacggntagtgttattacgtgtgtgacgataacgaggttggggancgtcgtcttcgccaggttggggccaacggggccctggttccgaacgttcctaaccg

SEQ ID NO: 353737 - DNA, 590 bp, Homo sapiens
  misc_feature: GZ8MTXP01AK4TK.25.75.G09.1.454.CMB.2.raw
  modified_base (266)..(266): a, c, t, g, unknown or other
  misc_feature (266)..(266): n is a, c, g, or t
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
  modified_base (493)..(493): a, c, t, g, unknown or other
  misc_feature (493)..(493): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctgggcctcagtgaaggtttcctgcaaggcttctggatacaccttcgcaagtcatgctcttcattgggncgccacggcccccgganaagggcttgagtggatgggatggatcaacnctgaccaatggtaaatgacaaactactcgaccaagaaactcccgaaagggcaagagtactaacgtttacgacgggacacacgtccgagacgtacaggctanagtggacctggagtcggctagggtacncggtagaacgtacgacggtcttagtgttattacgtgtggtagagagtaacgngggttgggggacttcgttccgtcccgcggttacccgttagggttcgggggacctaaccgggggtaccctcggggttacctaacccgttcgtaacccg

SEQ ID NO: 353738 - DNA, 546 bp, Homo sapiens
  misc_feature: GZ8MTXP01AN29T.25.75.G09.1.454.CMB.2.raw
  modified_base (266)..(266): a, c, t, g, unknown or other
  misc_feature (266)..(266): n is a, c, g, or t
  modified_base (283)..(283): a, c, t, g, unknown or other
  misc_feature (283)..(283): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
  modified_base (481)..(481): a, c, t, g, unknown or other
  misc_feature (481)..(481): n is a, c, g, or t
tcagactgtacagtcacgaccggtgctcgatttagtatagacatcaggggacccaacaaccacatccctcctcagaagccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggngcgccaggcccccgganagggcttgagtggatgggatggatcaacactgacccaaagtggtaaatggacaaactatgaccaagaaactccccgaagggcaaggagtcacgtttacgagggacacatccgngagtacaggctanagtggactgagtgcctggtatcgtgaagacacggctagtgtattactgtgtgagataacgaggttgggggancgtcgtccttcggaccaggttcgggggcccaagggggacccctgggccctaaccggttcgtcccg

SEQ ID NO: 353739 - DNA, 538 bp, Homo sapiens
  misc_feature: GZ8MTXP01D6W4Z.25.75.G09.1.454.CMB.2.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
tcagactgtacagtcacgaccggtgctcgatttagtatagacatcaggggacccaacaaccacatccctcctcagaagccctcagagcacaactcctcaccatggactggacctggaggatccttcttttttgtggcagcagccacaggtgcccactcccaggtccagcttgtgcagtcgtggggctggaggtgaagagccgtgggcctnagtgaaggtttccngcaggtcttcngatacnccttgcaagtcatgctcttcagtgggtgcgccgacggcccccggagaagggcttggagtggatgggatggatcaacnctgccaatggtaatgacaaactncgacccagaactcccgagggcagagtacacgtttacgagggacacacgtcgcgagtacaggctacgatcggactgagtcggctggtatcgtagaagacgacggcttatgttaattcgtgttagtgagaattacgagggtggggactcgtcgcgttcgacgtaagtcgggccgtagggcccttggtccgaaccgttcc

SEQ ID NO: 353740 - DNA, 553 bp, Homo sapiens
  misc_feature: GZ8MTXP01D6JH7.25.75.G09.1.454.CMB.2.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
  modified_base (480)..(480): a, c, t, g, unknown or other
  misc_feature (480)..(480): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagctgggctnagtgagttcngcagctngatacacttgcaagtcatgctcttcattgggncgccaggcccccgganaagggcttgagtggatgggatggatcaacnctgaccaatggtaaatgacaaacgtacacgacaagaacnccgaaggacaagacgtacgtacgttacgaggacacgactcgagagtacgagtactacgtagtcgacgtggacgtcgtcgtagtactacggtagaacgacgtacggtattagttagttagttagtggtagtagagagtaacgngggttgggcttcgtcgtccgttacgacgttcgggtcgggacgtaacgggtcctcggttacctccgttcgtccg

SEQ ID NO: 353741 - DNA, 547 bp, Homo sapiens
  misc_feature: GZ8MTXP01CGJU4.25.75.G09.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (471)..(471): a, c, t, g, unknown or other
  misc_feature (471)..(471): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggngcgccaggcccccgganaaggcttgagtggatgggatggatcaacactgccaatggtaatgacaaactactcgaccaagaaactcccgaaagggcaagagtcacgtttacgagggacacactccgacgagtacaggctacatggacctgagtgactggtatcgtgaagacgacggctatgtattacgtgtgtgagtataacgnggttggggagcgtcgtccgttcgaccttggttcggggccgtaacggggtccctggttacctaacccgttcgtcccg

SEQ ID NO: 353742 - DNA, 525 bp, Homo sapiens
  misc_feature: GZ8MTXP01EJ37U.25.75.G09.1.454.CMB.2.raw
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (338)..(338): a, c, t, g, unknown or other
  misc_feature (338)..(338): n is a, c, g, or t
  modified_base (404)..(404): a, c, t, g, unknown or other
  misc_feature (404)..(404): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggcttctggatacaccttcgcaagtcatgctcttcattgggncgccaggcccccganaaggcttgagtggatgggatggatcaanctgccaaatggtaaatgacaaactangaccaagaaactcccaaagggcaagagtcacggtttacagggacacatccgacgagtacaggctanatggacctgagtgctggtactgtagaagacacggctaatgtattagtgtgtgagctaagagttgggcgcgtcgtcttcgcacgttaagggcggcgggaccgtcgttcgtccgttcgtcccg

SEQ ID NO: 353743 - DNA, 538 bp, Homo sapiens
  misc_feature: GZ8MTXP01BIU65.25.75.G09.1.454.CMB.2.raw
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
  modified_base (486)..(486): a, c, t, g, unknown or other
  misc_feature (486)..(486): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggngcgccacggcccccgganaagggcttgagtggatgggatggatcaacactgccaatggtaaatgacaaactatcgaccaagaaactcccgaagggcaagagtctacgtttactagggacacatccgngagtacaggctanagtggacctgagtgcctggtactcgtagaagacacggctagtgtattacgtgtgtgaggataacgagggttggggacncgtcgtccttcgccagttcggggccgaacggggccctggctccgttctcccg

SEQ ID NO: 353744 - DNA, 596 bp, Homo sapiens
  misc_feature: GZ8MTXP01A7U91.25.75.G09.1.454.CMB.2.raw
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (325)..(325): a, c, t, g, unknown or other
  misc_feature (325)..(325): n is a, c, g, or t
  modified_base (352)..(352): a, c, t, g, unknown or other
  misc_feature (352)..(352): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgccaggcccccgganaaggcttgagtggatggatggatcaacactgaccaatggtaangacaatcacgacagaactccgaaggcngacgtactacgttacgacggacacacgtcgacgagtacgacgactacgacgtcggaccgtaggacggtcgtacgttagtacgtacgggaacgaacgaccgacgtcttagtacgtttaacgttagtggtaggtaggtaacgtaggtaacggtaggggttcggacgttccgttccgtaccgttacgcggttacgggtaaccgggccgggtaaccggtccggtaccgttacccgtccgttccgtccg

SEQ ID NO: 353745 - DNA, 629 bp, Homo sapiens
  misc_feature: GZ8MTXP01B062J.25.75.G09.1.454.CMB.2.raw
  modified_base (269)..(269): a, c, t, g, unknown or other
  misc_feature (269)..(269): n is a, c, g, or t
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
  modified_base (529)..(529): a, c, t, g, unknown or other
  misc_feature (529)..(529): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggcttcgtggatacaccttcgcaagtcatgctctcattgggncgccacggcccccggagaagggcttggagtggagtgggatggactcaacnctgaccaatggtaatgacaaactncgaccaagaaactcccgaaagggcaaggacgttaccgtaacggtttacgaaggggactaacgacgtcccgacgtaacgtaacgaggtactaacgaagttcgggaccctggaggtcgaccgttgggtaactcggtaggaacgaccgaccggtatattggttaattacgttgtgtagaagtgtaacgngggttaggggtagccgttccggtccgttacgttaccgttacgggttcgggggaccccgtaaggggggtccccttggggttccctaacccggttcctcccg

SEQ ID NO: 353746 - DNA, 624 bp, Homo sapiens
  misc_feature: GZ8MTXP01BGCJG.25.75.G09.1.454.CMB.2.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (283)..(283): a, c, t, g, unknown or other
  misc_feature (283)..(283): n is a, c, g, or t
  modified_base (557)..(557): a, c, t, g, unknown or other
  misc_feature (557)..(557): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtctggggctgaggtgaagagccgtgggcctnagtgaggttcngcaaggcttcngatacacttgcaagtcatgctcttcagttgggcgcgccgacggccccccgganaagggcttgaggtggagtgggatggatcaacacgtcgaccaaagttggtaaactggaacaaaacttacgtaccggacccaaaggaaaacctccccgaaaaggggaccaaggtacgtaccgtaaaccggttttaacgaacggggaaccacgtaacgtccggacgtacggtaacgaggtacctaacgagtcggacctggacgtcggccttggtactcggtaggaacgacgacggtctagtgttattacgtgtgtagagtactaagaggttggggancgtcgtcgttcgacgttaggttcggggcccgtaaggggtcccgtggttcccgtaaccggttctcccg

SEQ ID NO: 353747 - DNA, 560 bp, Homo sapiens
  misc_feature: GZ8MTXP01EMRF4.25.75.G09.1.454.CMB.2.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagctgggctnagtgagttcngcagctngatacactgcaagtcatgctcttcagttgggncgccgacggcccccgagaagggcttgagtggatgggatggatcaacnctgactaagtggtaatgacaaacgtctcgaccaagaaactcccgaaagggcaaggatcgtacgtttacgagggacacgactcgacgagtacaggctagagtcggactggagttcgcttaggtactcggtaggaacgtacgacggtcttagtgttacttagtgtgtaggagtagttaacggaggttggggacttcgtcgtccgttcgcgttacgggttcggggccgaacggggtccctgggttcctaaccggttcctcccg

SEQ ID NO: 353748 - DNA, 563 bp, Homo sapiens
  misc_feature: GZ8MTXP01ERXZX.25.75.G09.1.454.CMB.2.raw
  modified_base (209)..(209): a, c, t, g, unknown or other
  misc_feature (209)..(209): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (454)..(454): a, c, t, g, unknown or other
  misc_feature (454)..(454): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctnagtgaaggtttcctgcaaggcttctggatacaccttcgcaagtcatgctcttcattgggncgccacggcccccgganaagggcttgagtggagtgggatggatcaacactgaccaagtggtaaatgacaaactncgaccaagaaacncccgaaagggcaagatctaacgtttacagggacanactccgngagtacaggctaanagtggacctgagtcgctaggtactcggtagaagacgacggtntagtgttaattagtgtgtagagtagtaacgagggttgggagttccgtcgtccgttacgcgttacggttcggggcctaacgggggccctagggttcctcccgttctcccg

SEQ ID NO: 353749 - DNA, 612 bp, Homo sapiens
  misc_feature: GZ8MTXP01A8WXU.25.75.G09.1.454.CMB.2.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (480)..(480): a, c, t, g, unknown or other
  misc_feature (480)..(480): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcagtgaaggtttcctgcaaggcttctggatacaccttcgcaagtcatgctcttcattgggncgcacggccccganaggcttgagtggatgggatggatcaacnctgaccaagtggtaaatgacaaacgtactcgaccaagaaactcccgaaagggcaagacgtactacgtttacgagggacacgactcccgagaacgtacgaggctacgacgttcgggaccttggacggttcggccttagggtacttacggtaggaaacgaccgtaccgggtnttaagttcgttattacgttggtgtaggacgtagtaacgagggttcgggggacttcgtaccggtccgttcggaccgttaggttcgggggcccgtaacgggggtcccctggggttaccctcccgttccgtcccg

SEQ ID NO: 353750 - DNA, 544 bp, Homo sapiens
  misc_feature: GZ8MTXP01AG180.25.75.G09.1.454.CMB.2.raw
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
  modified_base (341)..(341): a, c, t, g, unknown or other
  misc_feature (341)..(341): n is a, c, g, or t
  modified_base (397)..(397): a, c, t, g, unknown or other
  misc_feature (397)..(397): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (493)..(493): a, c, t, g, unknown or other
  misc_feature (493)..(493): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggngcgccacggcccccgganaagggcttgagtggatgggatggatcaacactgccaagtggtaaatgacaaactntcgccaagaaactcccgaagggcaagagtcaacgtttacaggggacacgactccgngagtacaggctacatggacctgagtgcctgtatcgtagaagacacggctagtgtattacgtgtgtgagntaacgnggttggggacttcgtcgtccncggaccaggttcggggccgcggggtaccctggttcctaaccggttctcccg

SEQ ID NO: 353751 - DNA, 637 bp, Homo sapiens
  misc_feature: GZ8MTXP01DOKCG.25.75.G09.1.454.CMB.2.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcagtgaaggtttcctgcaaggcttctggatacaccttcgcaaagtcatgctcttcattgggncgccacggcccccgganaagggcttgagtggatgggatggatcaacnctgccaagtggtaatgacaaactatcgaccaagaaactcccgaaagggcaaggatcgtaacgtttaacaggggacacgactcccgacgaacgtacgacggtactaacgtagttacgggaaccttagggaacggttcgggtacccgttagggttaacttcggggttaaacggaacggaaaccgtacgggtactttaagttggtttaatttaacgttggttgtagtagaattaaggtagggttggggaacgttcgtaccgtccgttacgccgttaggttcggggaccgaacggggtacctcggttcctaaccgttctaacccg

SEQ ID NO: 353752 - DNA, 547 bp, Homo sapiens
  misc_feature: GZ8MTXP01A07FG.25.75.G09.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (396)..(396): a, c, t, g, unknown or other
  misc_feature (396)..(396): n is a, c, g, or t
  modified_base (487)..(487): a, c, t, g, unknown or other
  misc_feature (487)..(487): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgccacggcccccgganaaggcttgagtggatgggatggatcaacactgaccaatggtaatgacaaactatcgaccaagaaactccccgaaagggccaagagtacacgtttacagggacacatcccgngagtacaggctacgagtggacctggacgtgcctggtatcggtagaagtaccacggactatgtattactgtgtgagataacgaggttgggancgtacgtccttcgcaggttggggccgaaggggaccctgggttccaaccggttctaacccg

SEQ ID NO: 353753 - DNA, 565 bp, Homo sapiens
  misc_feature: GZ8MTXP01B7JNC.25.75.G09.1.454.CMB.2.raw
  modified_base (401)..(401): a, c, t, g, unknown or other
  misc_feature (401)..(401): n is a, c, g, or t
  modified_base (477)..(477): a, c, t, g, unknown or other
  misc_feature (477)..(477): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgcccgacggccccccggacgaagggcttggagtggagtgggatggatcgaacactgccaatggtaatgacaaactactcgaccagaaactcccgaagggcaagacgtcacgtttacagggacacactccgngagtacagctacgatggacctgagtcggcctggtactcgtgaagacgacggctagtgttattacgtgtgtagagtntaacgaggttggggattccgttcgtcccgttcgcccgttaggttcggggcccgcggggtacccctgggttcctaacccggttctcccg

SEQ ID NO: 353754 - DNA, 562 bp, Homo sapiens
  misc_feature: GZ8MTXP01BOHZL.25.75.G09.1.454.CMB.2.raw
  modified_base (221)..(221): a, c, t, g, unknown or other
  misc_feature (221)..(221): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (475)..(475): a, c, t, g, unknown or other
  misc_feature (475)..(475): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttccngcaaggcttctggatacaccttcgcaagtcatgctcttcattgggncgccacggcccccgganaagggcttggagtggatgggatggatcaacnctgacctaaagtggtaaatgacaaactactcggaccaagaaacctcccgaaaggggcaaggacgtacctaacggtttacgtagggacactacgtcccgagacgtacaggctacagtcggactggagtcgcgttaggtactcggtagaacgaccgacggtntagttgtaattcgtgtgtgagntaagaggttggggancgtcgtcncgcttaggtcgggcgtaacgggctcggttactcgttcgtccg

SEQ ID NO: 353755 - DNA, 550 bp, Homo sapiens
  misc_feature: GZ8MTXP01BWFZ2.25.75.G09.1.454.CMB.2.raw
  modified_base (343)..(343): a, c, t, g, unknown or other
  misc_feature (343)..(343): n is a, c, g, or t
  modified_base (471)..(471): a, c, t, g, unknown or other
  misc_feature (471)..(471): n is a, c, g, or t
  modified_base (493)..(493): a, c, t, g, unknown or other
  misc_feature (493)..(493): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccacggccccccggagaagggcttgagtggagtgggatggatcaacactgaccaatggaatgacaaactacncgaccaagaaactcccgaaagggcaagagtacacgtttacgagggaacacatccgagagtacaggcacgagtggactgagtcggcctggtatcgtaggaagacgacggtctagtgtaacttagtgtgngtagataacgaggttggggacncgtacgtcttacggcaggttcggggccgtaacggggccctgggctcccgttctcccg

SEQ ID NO: 353756 - DNA, 671 bp, Homo sapiens
  misc_feature: GZ8MTXP01DT6BV.25.75.G09.1.454.CMB.2.raw
  modified_base (227)..(227): a, c, t, g, unknown or other
  misc_feature (227)..(227): n is a, c, g, or t
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (574)..(574): a, c, t, g, unknown or other
  misc_feature (574)..(574): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtcgtggggctgaggtgaagagccgtggggcctgagtgagttcctgcagctngatacaccttgcaagtcatgctctcattggncgcgacggccccgagaggctgagtggagtggatggatacaacncgtcgactaagttggtaaatcgaacaaactactacgaccaaagtaaacgtcccgaaagggacaaggtacgtaccgtaaacgggtttactaacgggaccaacgtacgtcccgagtaaggtaccgaaggtctaacgaacgtcgggtaaccgttgggaacggttcggtacccgttagggttaaccgttacgggtaacggaaacgtaaccgtaccgggtaatttaacgttaggtttaactttaacgttggttaggtacgtaaggtaacgttaacggngggttacggggacttcccggttcgtcccgttacgttccgttaagggttcggggaccgtaacgggggtcccctgggttaccctaacccgttccttccg

SEQ ID NO: 353757 - DNA, 567 bp, Homo sapiens
  misc_feature: GZ8MTXP01DSI6F.25.75.G09.1.454.CMB.2.raw
  modified_base (209)..(209): a, c, t, g, unknown or other
  misc_feature (209)..(209): n is a, c, g, or t
  modified_base (269)..(269): a, c, t, g, unknown or other
  misc_feature (269)..(269): n is a, c, g, or t
tcagactgtacagtcacgaccggtgctcgatttagtatagacatcaggggacccaacaaccacatccctcctcagaagccccagagcacaactcctcaccatggactggacctggaggatccttctttttggtggcagcagccacaggtgcccactcccaggtccagcttgtgcagtctggggctgaggtgaagaagccgtggggcctnagtgaaggtttcctgcaaggcttcgtggatacacttcgcaagtcatgctctcagttgggncgccgacggcccccgagaaggcttgagtggatgggatggatcgaacactgaccaatggtaaatgacaaactactcgaccaagaaactcccgaaagggctaagagtcaacgtttacgagggacacactcccgagagtacgaggacctagagtggacctgagtcgctggtactcggagaagacaggactagtgtattagtgtgtagacgtaataagtagggttggggacttcgtcgtaccgttacgccttagggttcgggccgaacgggtacccctggttaccctaaccgttctaacccg

SEQ ID NO: 353758 - DNA, 652 bp, Homo sapiens
  misc_feature: GZ8MTXP01B94VW.25.75.G09.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
  modified_base (510)..(510): a, c, t, g, unknown or other
  misc_feature (510)..(510): n is a, c, g, or t
  modified_base (568)..(568): a, c, t, g, unknown or other
  misc_feature (568)..(568): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgccacggcccccgganaagggcttgagtggatgggatggatcaacnctgaccaagtggtaatgacaaactactcgaccaagaaactccccgaaagggaccaaggacgttaccgtaacggttttacgaaggggaacctaacgacgttcccggacgtaagtacgaagggccttaacgaagttcgggaacctgggaacggtcggtccttaggggtaacttcggtaggaaacgacgtaccgggtnttaagttggttaatttacgtgttgtaggaacgtagtaacggtagggttcgggggtacnccggttccgtcccgttacggaccgttagggttccgggggacccgaacgggggtacccctgggttaccctaacccgttcgtcccg

SEQ ID NO: 353759 - DNA, 610 bp, Homo sapiens
  misc_feature: GZ8MTXP01C1TBU.25.75.G09.1.454.CMB.2.raw
  modified_base (267)..(267): a, c, t, g, unknown or other
  misc_feature (267)..(267): n is a, c, g, or t
  modified_base (531)..(531): a, c, t, g, unknown or other
  misc_feature (531)..(531): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctgagtgtaaggtttcctgcaaggcttctggatacaccttgcaagtcatgctcttcattggngcgccacggcccccggagaggcttgagtggatgggatggatcgaacactgaccaaagttggtaaatgacaaactactacgaccagaaaactccccgaaaggggctaaggacgtcctaaacgttttaacgagggaccacgacgtcccgagaagtacgaggcttaacgaagttcggaaccttggagttggcctagggtactcgtaggaaagacctacggctagtgtatttacgtgtgtagaacgtagtaacgtgggttaggggtcnccgttccggtcccttacggccgttacggttcgggggaccgtcgggggtacccctggggttccctaacccggttctcccg

SEQ ID NO: 353760 - DNA, 574 bp, Homo sapiens
  misc_feature: GZ8MTXP01B7M0P.25.75.G09.1.454.CMB.2.raw
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (338)..(338): a, c, t, g, unknown or other
  misc_feature (338)..(338): n is a, c, g, or t
  modified_base (490)..(490): a, c, t, g, unknown or other
  misc_feature (490)..(490): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctnagtgaagtttccngcaaggcttctggatacaccttcgcaagtcatgctcttcattgggncgccacggccccgganaagggcttgagtggagtgggatggatcaacactgcctaatggtaatgacaaactntcgaccaagaaactcccgaagggcaagacgtacacgtttacagggacacgatccgcgagtacaggctacgaagtcggactggagtggccttgggtaatcggtaggaagacgacggtactaagtgttattaacgtggtgtagagaagtaacgngggttgggggattcgtcggtccttcggaccgttaggttcgggggaccgtcgggggaccctgggttccctaaccgttccgtcccg

SEQ ID NO: 353761 - DNA, 616 bp, Homo sapiens
  misc_feature: GZ8MTXP01A5YYQ.25.75.G09.1.454.CMB.2.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtcccagcttgtgcagtctggggctgaggtgaagaagccgtggggcctcagtgaaggtttcctgcaaggtcttcnggatacnccttgcaagtcatgctcttcattgggncgccacggcccccgganaagggcttgagtggagtgggatcggatacaaacacgtgaccctaaagttggtaaatggacaaactactacggaccaagaaactccccgaaagggcaaggtactaccgtaacgttttacgaagggaccaacacgtacccgacgaagtacaggacctaacgagtacggacctaggacggtcgcctaggtactcggtagaaacgacgaacggacttagtagttattacgtgtagtcgaggtataacgaagggttgggcggcgtcgtccgttccgccgacggttaacggggccggaacgggtaccggtcggttccgtaaccgttccgtccccg

SEQ ID NO: 353762 - DNA, 548 bp, Homo sapiens
  misc_feature: GZ8MTXP01A1Q3L.25.75.G09.1.454.CMB.2.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (459)..(459): a, c, t, g, unknown or other
  misc_feature (459)..(459): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
  modified_base (502)..(502): a, c, t, g, unknown or other
  misc_feature (502)..(502): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgcaggccccganaaggcttgagtggatggatggatcaacactgaccaaatggtaaatgacaaactatagacctaagaaactccccgaaaggggtccaaggagtccaacgttttacgaggggacacgactccgacgagtacaggactacgaagtcggacctgacgttgcctggtatcgtgaagtacacggntatgtattactgtgtgagataagngttagggggncgtcgtccncgcgagttcggggccgaaggggccctgggttcaaccggttctcccg

SEQ ID NO: 353763 - DNA, 616 bp, Homo sapiens
  misc_feature: GZ8MTXP01EF3EJ.25.75.G09.1.454.CMB.2.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggcttctggatacaccttcgcaagtcatgctcttcattgggncgccaggcccccgganaagggcttgagtggatgggatggatcaacactgaccaatggtaaatgacaaactactcgaccaagaaactccccgaaagggaccaaggagtacctaaacggttttaacgaaggggaaccacgtacgtacccggacgtaagtacgacgggaccttaacgagttggaacctggagtggccttaggtagtcgtaggaaacgacgaacgggtctaagtgttaatttacgtgtgtagtagactaagaggttggggacttcgtcgtcccgttagacccgttaggttcgggggcccgtaacggggtacccgtgggttacctaacccggttcttccccg

SEQ ID NO: 353764 - DNA, 665 bp, Homo sapiens
  misc_feature: GZ8MTXP01AH11P.25.75.G09.1.454.CMB.2.raw
  modified_base (207)..(207): a, c, t, g, unknown or other
  misc_feature (207)..(207): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (339)..(339): a, c, t, g, unknown or other
  misc_feature (339)..(339): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctnagtgaggtttcctgcaaggcttctggatacaccttcgcaagtcatgctcttcattgggncgccacggcccccganaggcttgagtggatgggatggatcgaacactgccaaagtggtaaatgactaaactcnggaccaagaaactcccgaaagggcaaggacgtctaacggtttacgagggacacgtactcccggacgtaagtaaccagggtacctaacgtaacgtcgggacccgttaggaacggttcgggtacccgttaggggtaactttaccgggtaggaaaacggtaccgtaaccggggtaccttaagttagttaagtttaaccgttggttaggtggaagtaagttaacggaagggttcgggggaacttccgttccggtcccgttacgaccggttagttcgggggacccgtaacgggggtacccctgggttacccgtaacccgttcgtaaccccg

SEQ ID NO: 353765 - DNA, 546 bp, Homo sapiens
  misc_feature: GZ8MTXP01CEQZ2.25.75.G09.1.454.CMB.2.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (352)..(352): a, c, t, g, unknown or other
  misc_feature (352)..(352): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagagctgggcctnagtgagttcngcaggctngatacaccttgcaagtcatgctcttcattgggngcgccacggcccccgganaagggcttgagtggagtgggatggatcaacactgccaatggtaatgacaaactatcgaccaagaaactcccgaagggacnggagtcacgtttactagggacacatccgcgacgtacgaggctacgatcggaccttgagtgcctaggtatcggtagaagacgacggtctagtgttattacgtgtgtagagataacgaggttgggggagcgtaccgtccttcggcgttcggttggggccgaacgggggaccctgggttcctaacccggttctcccg

SEQ ID NO: 353766 - DNA, 573 bp, Homo sapiens
  misc_feature: GZ8MTXP01EYDNE.25.75.G09.1.454.CMB.2.raw
  modified_base (266)..(266): a, c, t, g, unknown or other
  misc_feature (266)..(266): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (461)..(461): a, c, t, g, unknown or other
  misc_feature (461)..(461): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctgggcctcagtgaaggtttcctgcaaggcttctggatacaccttgcaagtcatgctcttcattgggncgccgacggcccccgagaaggcttgagtggagtggatggatacgaactctcgactaaagtggtaatgactaaagtcgtacgaccaagaaactcccgaaagggcaagacgtactacgtttacagggacacatccganagtacaggtcctanaagnggtacctggagttgcctaggtatcggtagaacgacacggtntagtgttaatcgttgtagtagacgtaataacgtagggttggggacttcgtccgtacgttcgaccgttagttcggggaccgtaacggggacctggttcctaaccgttctcccg

SEQ ID NO: 353767 - DNA, 715 bp, Homo sapiens
  misc_feature: GZ8MTXP01DND8K.25.75.G09.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggncgccacggccccgganaagggcttggagtggatggggatgggatacaacnctcgaccaagttggtaatgactaaactactcgaccaagaaactcccgaaagggaccaaggacgttacgtaaacggttttacgaaggggacaacgtacgtcccggacgacgtaacgacggaccttaacgacgttacgggaccttagggacgttacgggtccgttagggttactacggggttaaggaaacggtaccgaaccgggtcttaagttaggtttaactttacgtggttaggttaggaagttaaccgtaagggtaaggggtttcggggggaacgttcccgttaccgggttccccgttaccgggttacccggttaacggggtttccggggggaccccggaaccggggggttaacccccttgggggttacccctaacccgggtttccctttcccccgg

SEQ ID NO: 353768 - DNA, 598 bp, Homo sapiens
  misc_feature: GZ8MTXP01BLZSA.25.75.G09.1.454.CMB.2.raw
  modified_base (268)..(268): a, c, t, g, unknown or other
  misc_feature (268)..(268): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggngcgccacggcccccggagaagggcttgagtggatgggatggatcaacactgaccaagtggtaatgacaaactactcgaccaagaaactcccgaagggcaagagtcacgtttacgagggacacgactccgagagtacacggctacagtcggacctggagtacgccgttagggtacttcgtaggtaaagaccgaccgggattagtagttaagtttactgttggttagaggtaataagaagggttggggacgttccgttcggtccgttccgttaccttaggttcgggggaccgtaacgggggtacccgtcgggttaccctccgttcgtccccg

SEQ ID NO: 353769 - DNA, 692 bp, Homo sapiens
  misc_feature: GZ8MTXP01CYVMQ.25.75.G09.1.454.CMB.2.raw
  modified_base (217)..(217): a, c, t, g, unknown or other
  misc_feature (217)..(217): n is a, c, g, or t
  modified_base (266)..(266): a, c, t, g, unknown or other
  misc_feature (266)..(266): n is a, c, g, or t
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
  modified_base (589)..(589): a, c, t, g, unknown or other
  misc_feature (589)..(589): n is a, c, g, or t
tcagactgtacagtcacgaccggtgctcgatttagtatagacatcaggggacccaacaaccacatccctcctcagaagccccagagcacaactcctcaccatggactggacctggaggatcctctttttggtggcagcagccacaggtgcccactcccaggtccagcttgtgcagtctggggctgaggtgaagagctggggcctcagtgaggttccngcaaggcttcgtggatacaccttcgctaagtcattgctcttcattgggngcgccacgggccccccggagaagggcttgagtggagtgggatggactacaacgactgaccaagttggtaaatcgacaaacgtntacggaccaagtaaacncccgaaagggacaagtacgtacgaacgtttaaccgaaggggacctacgacgtaccgacgaacggtaaccgagggtaccttaaccgaagttacgggaaccttagggaagtcgggtaccttagggtaacgtacgtacggaaacgtaccgaccgggtacttaaagtcggttaatttaaccgttggtaggttagaacggttaattaacggaagggttgggggaaacnccgtttccgggtccgttaccggaccgttaacgggtttcgggggaacccgttaaccggggggccccttagggggttacccctaacccgggttccttaaccccgg

SEQ ID NO: 353770 - DNA, 598 bp, Homo sapiens
  misc_feature: GZ8MTXP01DRKFH.25.75.G09.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (312)..(312): a, c, t, g, unknown or other
  misc_feature (312)..(312): n is a, c, g, or t
  modified_base (352)..(352): a, c, t, g, unknown or other
  misc_feature (352)..(352): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctgggctgaggtgaagagcctgggcctnagtgagttcngcagcttcngatacacttgcaagtcatgcttcttcagttgggcncgcccgacggccccccgganaagggcttggagtggagtgggatggatcaaacncgtgaccaatggtaactgactaaactacacgacaagaacncccgaaggacaagtacgtacgtaacgttacgacggacacgacgtccgacgtacgtaacgacgtactaacgagtacggacgtggacgtcggtcgtagtactacggaagaacgacgacggtattagtgttacttagtgtcgtagaacgtaataacggagggttacgggacttccggtccgtccgttaccgcggttacggttcggggaccggtaacgggtcccgtcggttccgtaacccgttcgtcccg

SEQ ID NO: 353771 - DNA, 608 bp, Homo sapiens
  misc_feature: GZ8MTXP01DKDH9.25.75.G09.1.454.CMB.2.raw
  modified_base (226)..(226): a, c, t, g, unknown or other
  misc_feature (226)..(226): n is a, c, g, or t
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
  modified_base (480)..(480): a, c, t, g, unknown or other
  misc_feature (480)..(480): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtcgtggggctggaggtgaagaagccgtggggcctgagtgaaggtttccngcaaggtcttctggatacaccttcgacaagtcatgctcttcattgggncgccacggccccganaaggcttgagtggagtggatggatacaacacgtgaccaagtggtaaatcgaactaaactactacgaaccaagaaaactcccgaaagggacaagagtctaacgtttacgaagggacacactccgacgaagtacaggactacgaagtcgggaactggagtcgtccgtaggttactgtagaaacgacaacggtnttagtagttagttacgtgtagtagagagtaaggagggttgggtacgttccgtccgtaccgttacgttaccggttacggtccggggaccgtaaccgggtcccgtcggttacccgtcccgttccgtcccg

SEQ ID NO: 353772 - DNA, 597 bp, Homo sapiens
  misc_feature: GZ8MTXP01BHU40.25.75.G09.1.454.CMB.2.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (499)..(499): a, c, t, g, unknown or other
  misc_feature (499)..(499): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtcgtggggctgaggtgaagagccgtgggctnagtgagttcngcagctngatacactgcaagtcatgctcttcagttgggncgccgacggccccgagaggcttggagtggagtgggatggatacactactcgactaagtggtaatgaactaaactcgacgaccaagtaaacctcccgaaagggtaccaagtacgtacgtaacgtttacgagggacacgtacgtccgagtaacgtacaggactacgagtcggactggagtcgctagtactcggagaacgtacaggtctagttgttaattacgtgtagtagtagtagttaacggngggttaggggacttccgttaccggtcgttaccggaccgttagggttccggggaccggtaacggggtaccctgggttaccctaaccggttccctaaccg

SEQ ID NO: 353773 - DNA, 596 bp, Homo sapiens
  misc_feature: GZ8MTXP01EM4X8.25.75.G09.1.454.CMB.2.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtctgggctgagtgaagagctgggctnatgagttcngcagctngatacacttgcagtcatgctcttnagttgggncgccgacggccccggagaggcttgagtggatgggatggatcaacactcgactaagtggtaatgacaaactactcgaccaagaaactcccgaaagggcaagtagtaccgtaacgtttacgagggacacgtactcccgagacgtacgaggtcctaacgtagtacggaccttggagttcggacttggtactcggtagaacggactacggtattagttcgtttaatttacgttggtgttacggtaagtgtaacggtagggttgggggtacttcgttcggtacccgttgccggttagggttccgggggcgaacgggggtaccctgggttcctaaccggttccttaacccg

SEQ ID NO: 353774 - DNA, 699 bp, Homo sapiens
  misc_feature: GZ8MTXP01B9DUR.25.75.G09.1.454.CMB.2.raw
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggcttctggatacaccttcgcaagtcatgctcttcattgggtgcgcccgacggccccccgganaagggcttggagtggagtgggatggatcaacnctgaccaagtggtaaatgacaaactntcgaccaagaaactcccgaaaggggaccaaggagtcctaacggttttacgaagggacaacgacgttcccgacgtaagtaacagggtactaacgaagtcgggaacccttggacggttcgggccttagggtacttccgggtaggaaacggtaccgtacgggtaccttaagttacgttaagtttaaccgttggttaggtagtaagtaacgttaaacggtaggggttacgggggtaacttccgtttccgggttccccgttaccgggttacccgttacgggtttccggggggaccccgtaacggggggttacccccttgggggttaccccgttaaccccgggttcccttcccccgg

SEQ ID NO: 353775 - DNA, 577 bp, Homo sapiens
  misc_feature: GZ8MTXP01BMPHE.25.75.G09.1.454.CMB.2.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (270)..(270): a, c, t, g, unknown or other
  misc_feature (270)..(270): n is a, c, g, or t
  modified_base (316)..(316): a, c, t, g, unknown or other
  misc_feature (316)..(316): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgccccactcccaggtccagcttgtgcagtctggggctgaggtgaagaagcctggggcctnagtgaaggtttccngcaaggcttctggatacaccttcgcaagtcatgctcttcattgggncgccaggcccccggaaagggcttgagtggatgggatggatcaaacnctgaccaaagtggtaaatgacaaaactatcgacccaaagtaaactccccgaaaggggccaaggtacgtctaaacggttttaaccaaggggaacacgaactcccggagaagtacaggctaacgaagttcggaacctggagtcgcgtaggtatcgtagaagaacgaaggatagtagtattatgtgtgagataataggttgggagcgtcgtcttcgccgttagttgggcggaacgggaccgtcggttcgtaaccgttcgtcccg

SEQ ID NO: 353776 - DNA, 585 bp, Homo sapiens
  misc_feature: GZ8MTXP01BO3WX.25.75.G09.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgccaggcccccgganagggcttgagtggntgggatggatcaacnctgccaatggtaatgacaaactctgaccaagaactcccgaagggcaagacgtacacgtttacagggacactatccgagacgtacaggctacgatcggacctggacggttcgccgtagggttactcgtaggaagtacgacgggtctaagttgttattacgtggttgtggtacgagtaagtaagggttgggggaacttcgtccgtcccgttacgacccgttagttccgggggcctaacgggggcccctgggttacctaacccggttcgtccccg

SEQ ID NO: 353777 - DNA, 616 bp, Homo sapiens
  misc_feature: GZ8MTXP01BCXP4.25.75.G09.1.454.CMB.2.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (258)..(258): a, c, t, g, unknown or other
  misc_feature (258)..(258): n is a, c, g, or t
  modified_base (302)..(302): a, c, t, g, unknown or other
  misc_feature (302)..(302): n is a, c, g, or t
  modified_base (524)..(524): a, c, t, g, unknown or other
  misc_feature (524)..(524): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtgggcctnagtgaagttcngcagcttcngatacacttgcaagtcatgctcttcattggngcgccgacggccccgagaggctgagtggatgggatggatcaacncgtgacctaagtggtaatgacaaactactcgaccaagaaactcccgaaagggcaagagtacgtacgtttacgagggacacgactccgacgtagtacacggactacgagtacggtacctggagttcgaccgttaggttactcggttaaggaacgaccgtaacgggtacttaagttgttaatttacgtgttggtagtaagtagtaacggtgggttaggggtacnccgttccgtccgttaccgttaccgttacgggttccgggggacccgtaacgggggtacccgtcgggttacccgtaacccgttcccgtaacccg

SEQ ID NO: 353778 - DNA, 597 bp, Homo sapiens
  misc_feature: GZ8MTXP01DJP0H.25.75.G09.1.454.CMB.2.raw
  modified_base (271)..(271): a, c, t, g, unknown or other
  misc_feature (271)..(271): n is a, c, g, or t
  modified_base (437)..(437): a, c, t, g, unknown or other
  misc_feature (437)..(437): n is a, c, g, or t
  modified_base (516)..(516): a, c, t, g, unknown or other
  misc_feature (516)..(516): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggtcttctggatacaccttcgcaagtcatgctcttcagttgggncgccgacggccccccggagaagggcttggagtggagtgggatggatacaacactcgaccaaagtggtaatgactaaactactcgaccaagaaacctcccgaaagggcaaggacgtccgtaaacggtttacgaacgggacacgacgtccgacgaagtacgagactanagtcggactggagtcgcttaggtatcggtagaacgacgacggtactagtgttaattacgtgtgtagagtaagtaacggngggttggggacttcgtaccgtccgttacgcgttagggttccgggaccgcggggtaccctcgggttacctccgttcgtcccg

SEQ ID NO: 353779 - DNA, 726 bp, Homo sapiens
  misc_feature: GZ8MTXP01CL6QQ.25.75.G09.1.454.CMB.2.raw
  modified_base (222)..(222): a, c, t, g, unknown or other
  misc_feature (222)..(222): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctgagtgaaggtttccngcaaggtcttctggatacaccttcgacaagtcatgcttcttcattgggncgccaggcccccganaggcttgagtggatgggatggactcaacnctgaccaagttggtaaatgaaactaaactacgtaccgaaccgaaagtaacccgtaccggaaacgggactaaggtacgttaaccgttaaccggtttaaacggaacgggaaccctaacgtacccgttaccgacggtaacggtaaccgacggtaaccttaacggtacggttaccggtaaccgtagggtaacggttccggtaccggttagggttaccgttaccggggttaaggaaaaccggtaccggtaacggtacttaagttagtttacgtttaagtgtggtagtaagttagtaacggtaaggggttcgggtaaccttccgttacccggttccgaccgttaccggttacggggttaacccggggccgggtaacccgggtacccgttccggacccgttcccgttcccgttccccg

SEQ ID NO: 353780 - DNA, 622 bp, Homo sapiens
  misc_feature: GZ8MTXP01BCXZO.25.75.G09.1.454.CMB.2.raw
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (546)..(546): a, c, t, g, unknown or other
  misc_feature (546)..(546): n is a, c, g, or t
  modified_base (593)..(593): a, c, t, g, unknown or other
  misc_feature (593)..(593): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaagtttcctgcaaggcttcnggatacaccttgcaagtcatgcttcttnagttgggngcgccgacggcccccgganaagggcttgagtggatgggatggatcaactacgtgaccaaagttggtaaatgaactaaactactcggaccaaagaaacctccccgaaaggggacctaagaagttcctaaacgttttaacggagggaactacgactaccggcgtaagtaacgaggtaaccttacgagtacggtacctaggagtcgggccttagggtactgggtaaggaaacgccgaacggtctaagtgttaacttacgtgtaggttagacgtataacgngggttagggtacgccgtacggtccttacgcgttacggtcgggaccgngggtaccctggcctaaccgttcgtaaccg

SEQ ID NO: 353781 - DNA, 634 bp, Homo sapiens
  misc_feature: GZ8MTXP01APCY1.25.75.G09.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggncgccaggcccccgganaagggcttgagtggatgggatggatcaacnctgccaagtggtaatgacaaactactcggaccaagaaactcccgaaaggggccaaggacgtaccgaaacggttttacgaaggggaacacgacgtacccgcgaacgtacgaacgggccttaacgaagttcgggaaccttggaacggttggtcccgttagggttaactccggttaggaaacgtaccgacgggtacttaagtggttattaacgtgtgtagtagagttaacgaggttgggggacttcgttccggtcccttcggaccttagggttcgggggcctaacgggggtacccctcggggttcctaaccccggttctccccg

SEQ ID NO: 353782 - DNA, 557 bp, Homo sapiens
  misc_feature: GZ8MTXP01BQU8X.25.75.G09.1.454.CMB.2.raw
  modified_base (206)..(206): a, c, t, g, unknown or other
  misc_feature (206)..(206): n is a, c, g, or t
  modified_base (283)..(283): a, c, t, g, unknown or other
  misc_feature (283)..(283): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccagatccagcttgtgcagtctggggctgaggtgaagagcctgggcctnagtgaaggtttcctgcaaggcttctggatacaccttcgcaagtcatgctcttcatgggtgcgccacggcccccgganagggcttgagtggatgggatggatcaacactgaccaagtggtaatgacaaacctatcgacccaagaaactcccgagggcagagtcacgtttacgagggacacactccgcgagtacgaggctacgagtcggacctggagtcggcctggtaagtcgtaggaagacgacggtctagtgtattcgtgtagtgagtaagtacgagggtgggagtcgtcggttccgttcgaccgtaaggttcggggccgacgggggtacccttcgggtccttccgtcccg

SEQ ID NO: 353783 - DNA, 711 bp, Homo sapiens
  misc_feature: GZ8MTXP01B37J5.25.75.G09.1.454.CMB.2.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggcttctggatacaccttcgcaagtcatgctcttcattgggncgccacggcccccgganaagggcttgagtggatgggatggatcaacactgcctaagtggtaatgactaaactactcgaccaagaaactccccgaaaggggccaaggagttaccaacggttttaccgaaggggtaccacgacgttccccgacgtaacggttaaccgagggtaccttaacgaaacgttcgggaacccgttggaacggttcgggaccctttaggggttaacttacgggttaggaaacggtaaccgtaacggggtcctttaaagttcggtttaatttaaccgtggttagtaggtaacgtagttaacggaaggggttgggggtacgttccgtttaccgggtcccgttccggttaacccgttacgggtttcgggggaccccgtaacggggggtacccccttcgggggttacccctaacccggggtttcccttccccgg

SEQ ID NO: 353784 - DNA, 582 bp, Homo sapiens
  misc_feature: GZ8MTXP01BBQZA.25.75.G09.1.454.CMB.2.raw
  modified_base (231)..(231): a, c, t, g, unknown or other
  misc_feature (231)..(231): n is a, c, g, or t
  modified_base (265)..(265): a, c, t, g, unknown or other
  misc_feature (265)..(265): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (402)..(402): a, c, t, g, unknown or other
  misc_feature (402)..(402): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (506)..(506): a, c, t, g, unknown or other
  misc_feature (506)..(506): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaagttcctgcaaggcttcnggatacacttcgcaagtcatgctcttcattgggncgccacggcccccgagaggctgngtggatggatggatcgaacnctcgacctaatggtaatggacaaacgtatcggacctaagaaactcccgaaagggacaagacgtacgtacgtttacgtaagggacacacgtccgngtaagtacgaggtctacgagttcgacctggagttcggacgttagtagtcgtagaaacgacacgggtacttagtagttnttaacgngttgacgatagtaacgggngggttagggcttcgtccgtacttaccgcgttacgggtccgggccggtaacgggccgtggaccctccgttccgtccg

SEQ ID NO: 353785 - DNA, 617 bp, Homo sapiens
  misc_feature: GZ8MTXP01EF5LH.25.75.G09.1.454.CMB.2.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtctggggctgaggtgaagagcgtgggcctnagtgagttctgcagcttngatacncttcgcaagtcatgctctcattggncgcacggccccganaggctgngtggatggntggatcaacnctgacaagtggtaaatgacaaactctacgaccaagaaactcccgaaagggacaagacgttaccgtaacggtttacgaacggggacaacgtacgtcccgacgtaacgtaacgaggtacctaacgaacgtacgggtaaccttgggaacggtcggtccgttagggttactaccgggtaaggaaacggacgacgggtacttaagttagtttattacgtgttaggtagtacgtagtaacggtagggttggggattccgttacgtccgttacgacgttacgggtcggggaccgtcgggtaccctggttcctaacccgttctaacccg

SEQ ID NO: 353786 - DNA, 618 bp, Homo sapiens
  misc_feature: GZ8MTXP01A2NJS.25.75.G09.1.454.CMB.2.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtctggggctgaggtgaagagcgtgggcctnagtgagttcngcagcttngatacnctcgnaagtcatgctnttnagttggncgccacggccccgganagggcttgagtggagtggatggatacaacacgtgacctaagtggtaatgacaaactcacgaccaaagaaacctcccgaagggtacaaggactaccgtaacgtttacgagggaccacgacgtccgagagtacgaggtacctaagaacgtcggacctaggagtcggtcctagggttactcggtaaggaaacgtacgtacggtattagtgtttaagtttacgtgggttaggtagggtagtaacggtggggtacgggggttactccgttccggtaccgtacggaccggttaggttccgggggaacccgaggggtcccttggggcccttaccggttccttcccgtaaccg

SEQ ID NO: 353787 - DNA, 670 bp, Homo sapiens
  misc_feature: GZ8MTXP01DMYHS.25.75.G09.1.454.CMB.2.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctnagtgaaggtttccngcaaggcttctggatacaccttcgcaagtcatgctcttcattgggncgccacgggcccccgagaggcttgagtggatgggatggatcaacacgtgacctaagtggtaaatgaacaaacttactccgaccaagaaacctccccggaaagggaccaaggtacgttacctaaaccggttttaacgaggggaccaacgtaacgtccggacgtaacgtaacgaggtaccttaaacacgtcgggtaaccctgggtaaggtcgggtaccgttagggttacttcggggtaaggtaaacgaccgtaccgggtacttaagttggttaagtttacgtgttaggtagaagtagttaaggaggggttggggacgttcgttccgtcccgttacgacccggttggttccgggggaccgtaacgggggtaccccgtggttacccgtaaccgttccctaacccg

SEQ ID NO: 353788 - DNA, 549 bp, Homo sapiens
  misc_feature: GZ8MTXP01CA185.25.75.G09.1.454.CMB.2.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
  modified_base (502)..(502): a, c, t, g, unknown or other
  misc_feature (502)..(502): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggncgccaggcccccganaagggcttgngtggatgggatggatcaacnctgccaatggtaatgacaaactacncgaccagaaactcccgaagggccngagtcacgtttacagggacacatccgcgagtacaggctacagtcggacctgagtggcctggtactcggtagaagacacggtctagtgtagttactggtgtagagtataacgaggttggggacttcgtaccggtcttcgccnggttcgggggcccaagggggtaccctgggttacctccggttctcccg

SEQ ID NO: 353789 - DNA, 703 bp, Homo sapiens
  misc_feature: GZ8MTXP01BV001.25.75.G09.1.454.CMB.2.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctgagtgaaggtttccngcaaggcttgngatacaccttcgcaagtcatcgctcttcgattgggngccgccgacggcccccggtagaacgggtcttggaggtggagtgggatggactacaacacgtacgaccaaagttgggtaaatcggaactaaaacttacgtaccggaccaaagtaaaaccgtcccccggaaaaggggtaccaaggtaacgtttaccgtaaaccggttttaaccgaacggggaccaaccgtacgttacccggaggtaacggtacgacggtacctacgagtccgggaacctgggagttcggtaccgtagttacgtcggtaggaacgtaccgacggtacttaagtgttaacgttacgtggttacgtagaagtgtaacggtaggggttcggggacgttccgttccggtccccttacgggaccggttacggtttcggggggccctaacgggggttaccccgtgggttaccccgtaaccggttccttccccg

SEQ ID NO: 353790 - DNA, 613 bp, Homo sapiens
  misc_feature: GZ8MTXP01CAKAR.25.75.G09.1.454.CMB.2.raw
  modified_base (223)..(223): a, c, t, g, unknown or other
  misc_feature (223)..(223): n is a, c, g, or t
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
  modified_base (537)..(537): a, c, t, g, unknown or other
  misc_feature (537)..(537): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttccngcaaggtcttcgtggatacaccttcgcaagtcatcgtctcttcattggngccgccgacggcccccgganaagggtcttggagtggagtggatggatcaacacgtgacaagtggtaatgacaaacttacncgaccaagaacgtcccgaaggacaagatacgaacgtttacagggacacgactcccgagtagtacggaggtactaacgagttacggacctaggacgtcgggaccttagggtactcgtaaggaacgaacgacggtataagttcgttaattatgtagtagtaagtagtaacggaaggttcggggaacnccgtacgtccgttacgaaccgttgggttcggggacccgaaggggtacccctgggttacctaacccgttcgtccccg

SEQ ID NO: 353791 - DNA, 576 bp, Homo sapiens
  misc_feature: GZ8MTXP01E4J20.25.75.G09.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (501)..(501): a, c, t, g, unknown or other
  misc_feature (501)..(501): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggncgccaggcccccgganaagggcttgagtggatgggatggatcaacactgccaatggtaaatgacaaactactcgaccaagaaactcccgaagggcaagagtcacgtttacgagggacacacgtccgcgagtacaggctacatggacctgagtcgcctggtactcggtgaaagtacacggctagtgtattcgtgtgtagagaataacgaggttgggggattccgtccggttccnccggacgttacggttcgggggcccgtaacggggggaccccttggggttaccctaacccgggttcccttaaccccg

SEQ ID NO: 353792 - DNA, 710 bp, Homo sapiens
  misc_feature: GZ8MTXP01BXNU1.25.75.G09.1.454.CMB.2.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (264)..(264): a, c, t, g, unknown or other
  misc_feature (264)..(264): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtcgcccactcccaggtccagcttgtgcagtcgtggggctgaggtgaagagccgtgggcctnagtgagttcngcagtctntgatacaccttcgctagtcatgctcttcagttgggngccgccgacggcccccgagagggcttggagtggagtgggatggactacgaactctggacctaagttggtaaatcgacctaaaacgttacgtaccgacctaaagtaaaaccctccccggaaaggggaccaacgggtaacgttacccgttaaacggttttaaaccggaacggggaacctaaccgtaccgtacccgggacgtaaaggttaccgaggtacctaacgtacgtacgggtacccttaggggacgttcgggtaccgttagggttaactacgggttaacggaaacgtaccgtaacgggtacttagttaagttagtttacgtggtacgttaggagtaagtaacggtgggttggggacttcgtaccggtccgttacggttcgttacgggttaacgggggacccgaacgggggtaccccttggggttcccctaaccggttctaacccg

SEQ ID NO: 353793 - DNA, 655 bp, Homo sapiens
  misc_feature: GZ8MTXP01EG4K2.25.75.G09.1.454.CMB.2.raw
  modified_base (271)..(271): a, c, t, g, unknown or other
  misc_feature (271)..(271): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggtcttctggatacaccttcgcaagtcatgctcttcagttgggncgccgacggcccccggagaagggtcttgagtggagtggatggatacaacgctacgaccaagtaggtaatgaactaaactacgtcgaccaaagaaactcccgaaaggggacctaaggaacgttaccgtaaacggttttaaccgaacgggggacaacgacgttacccggacgtaacggtacgaagggtcctaaacgacgttcgggaacctgggaggtcggccgtaggtacgtcgtaggaaagacgacgggtattaagttgttacttaacgtggtagtagacgtaagtaacgtaagggttgggggacttcgtaccggtcccttacggttacgttcggtcgggggacccgtaagggggtcccctggggttacctcccgttcggtcccg

SEQ ID NO: 353794 - DNA, 616 bp, Homo sapiens
  misc_feature: GZ8MTXP01DMUA0.25.75.G09.1.454.CMB.2.raw
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (344)..(344): a, c, t, g, unknown or other
  misc_feature (344)..(344): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcagtgaaggtttcctgcaaggcttctggatacaccttcgcaagtcatgctcttcagttgggcncgccacgggcccccgganaagggcttggagtggatgggatggatcaacactgaccaagtggtaatgacaaactncgaccaagaaactcccgaaagggcaagacgtacgtaacgtttacgagggacacgactccgagaagtacaggacttacgagtcggacctggacgtcggaccgttgggtactcggtaggaaacggtccgaacgggtacttaagttcggttaactttaacgtgttggtagtagagtaacgagggttgggggattccgtcgtcccgttcgaccgttagggttccgggggcccgtaacgggggtacccctggttacccgtaacccgttctaaccccg

SEQ ID NO: 353795 - DNA, 595 bp, Homo sapiens
  misc_feature: GZ8MTXP01DVL60.25.75.G09.1.454.CMB.2.raw
  modified_base (219)..(219): a, c, t, g, unknown or other
  misc_feature (219)..(219): n is a, c, g, or t
  modified_base (264)..(264): a, c, t, g, unknown or other
  misc_feature (264)..(264): n is a, c, g, or t
  modified_base (316)..(316): a, c, t, g, unknown or other
  misc_feature (316)..(316): n is a, c, g, or t
tcagactgtacagtcacgaccggtgctcgatttagtatagacatcaggggacccaacaaccacatccctcctcagaagccccagagcacaactcctcaccatggactggacctggaggatcctctttttggtggcagcagccacaggtgcccactcccaggtccagcttgtgcagtctggggctgaggtgaagaagcctggggcctcagtgagtttccngcaaggcttctgatacaccttcgcaagtcatgctcttcattgggngcgcccacggccccccggagaagggcttggagtggagtgggatggatcaacnctgaccaagttggtaaatgactaaactactcgaccaagaaactccccgaaaggggcaaggacgtacctaacgtttacgaggggacacactccgacgagtacaggctacagtggacctggacgtcggcctaggtatcggtagaaacgacgacggtctagttgttatttacgttgtttagagtactacgaagggttggggagtccgttcgtcccgtcggaccgttaggttcgggggaacccgacgggggtccctgggtaccacccggttcttcccgtcccg

SEQ ID NO: 353796 - DNA, 607 bp, Homo sapiens
  misc_feature: GZ8MTXP01BGZN2.25.75.G09.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (254)..(254): a, c, t, g, unknown or other
  misc_feature (254)..(254): n is a, c, g, or t
  modified_base (298)..(298): a, c, t, g, unknown or other
  misc_feature (298)..(298): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcgtgggctnagtgagttcngcagctngatacacttgcaagtcatgctctcagttgggncgccgacggccccgagaggcttgagtggagtggatggatcaacncgtgacctaaagtcggtaaatcgaactaaacgtactcgaccaagaaacctcccggaaagggacaaggtacgttaccgtaaacgtttacgtaacgggaactacgacgtccggagaaggtacgaggactacgagtcggaacgtgacggtcggtccgtaggtactacggtaggaagacgtacggtctagtgttacgttagtgtaggtagtaagtacgtaaggtgggttaggggcttccgtacgtcccgttcggacgttacgggtccggggaccggaacgggtcccgtcggttacctaaccggttccgtcccg

SEQ ID NO: 353797 - DNA, 641 bp, Homo sapiens
  misc_feature: GZ8MTXP01CMZW9.25.75.G09.1.454.CMB.2.raw
  modified_base (225)..(225): a, c, t, g, unknown or other
  misc_feature (225)..(225): n is a, c, g, or t
  modified_base (278)..(278): a, c, t, g, unknown or other
  misc_feature (278)..(278): n is a, c, g, or t
  modified_base (334)..(334): a, c, t, g, unknown or other
  misc_feature (334)..(334): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtcgcccactcccaggtccagcttgtgcagtcgtggggctgaggtgaagagccgtggggcctgagtgaaggtttccngcaaggtcttcgtggatacaccttcgctaagtcatcgcttcttcgagttgggngccgcccgacgggccccccggagaagggtcttggagtggagtgggatggatcaacnctgaccaagtggaatcgaacaaacttcacgaccaagaaacctccgaaagggcaaggtagtccgtaacggtttacgagggacctacgacgtcccgagtagtacgacgggactaacgagttacgggaccgtggacggttcggaccgttagggtactcggtaggaacgaccgtacggtacttagtcgttatttacgtggttggtagaagtagtaacgagggttggggacgttcgttcggtccttcggttacgttacgggttccgggggccgtaacgggggtacccttcgggccctaaccgttccgtcccg

SEQ ID NO: 353798 - DNA, 724 bp, Homo sapiens
  misc_feature: GZ8MTXP01CIS38.25.75.G09.1.454.CMB.2.raw
  modified_base (209)..(209): a, c, t, g, unknown or other
  misc_feature (209)..(209): n is a, c, g, or t
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctnagtgtaaggtttcctgcaaggtcttgtggataccaccttcgacaagtcatgcttcttcgtattgggngccgccgacggccccccgganaagggtcttgagtggatgggatggatcgaacnctgacctaagtaggtaatgaactaaaactactcggaccaagtaaacctacccgaagggaccaaggacgttacgtaaaccgggttttaaacgaacggggtaaccaacaacgttacccggacgaaacggttaccgaacgggtacctaaacgtacgtaccgggtaccgtagggtaaccggttcggaccccggttaggttaaacgtccggttaaggaaacggaaccgtacgggacctttaagtacgttaagttaacgtggttaccgtaggtaagtaacggtaacgtaaagggttcgggggaacttccgttaaccgttccgaccggttccgttagggttccgggggccggtaacgggggtacccctacggggttacctaacccgggttcccttaacccgg

SEQ ID NO: 353799 - DNA, 577 bp, Homo sapiens
  misc_feature: GZ8MTXP01EMVH8.25.75.G09.1.454.CMB.2.raw
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (316)..(316): a, c, t, g, unknown or other
  misc_feature (316)..(316): n is a, c, g, or t
  modified_base (565)..(565): a, c, t, g, unknown or other
  misc_feature (565)..(565): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagctgggcctcagtgaagttcctgcaaggcttctggatacaccttcgcaagtcatgctcttcagttgggncgccacggcccccgganaagggcttggagtggagtgggatggatacgaaacnctgacctaaagtggtaaatgactaaactctcgaccaagaaactcccgaaagggcaagacgtactacgtttacgagggacacgtatccgagagtacgaggctagagtggacctggagtcgggcttagggtactcgggtagaaagtacgacggtctagtcgttaattacgtgtgagagagtaacgaggttggggacttcgtcgtccttcggacgttagggtcggggaccgaacggggtccctgggttaccnccggttctcccg

SEQ ID NO: 353800 - DNA, 616 bp, Homo sapiens
  misc_feature: GZ8MTXP01DFCIM.25.75.G09.1.454.CMB.2.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (300)..(300): a, c, t, g, unknown or other
  misc_feature (300)..(300): n is a, c, g, or t
  modified_base (539)..(539): a, c, t, g, unknown or other
  misc_feature (539)..(539): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtcgtggggctgaggtgaagagccgtgggcctnagtgagttcngcagtctngatcacttgnagtcatgctctngttggngcgccgacggccccganagggcttgagtggagtggatggatcaacnctgactaagtggtaatgacaaactctcgaccaagaaactcccgaaagggacaaggtacgttacccgtacggtttaacgaagggaccacgacgttcccggacgtaacggtacgaggtacttaacgaaggttcggaaccgttgggaacggttcggtaccgttagggtacgttacggtaacggaaacgtaccgtaccgggtattaagttagttatttacgtggtagtagaacgtgtaacggngggttgggacttcgtccggtccgttacgcgttaggttccggggaccgtcggggtccctcggttcctccgttctcccg

SEQ ID NO: 353801 - DNA, 625 bp, Homo sapiens
  misc_feature: GZ8MTXP01CITDB.25.75.G09.1.454.CMB.2.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (354)..(354): a, c, t, g, unknown or other
  misc_feature (354)..(354): n is a, c, g, or t
  modified_base (427)..(427): a, c, t, g, unknown or other
  misc_feature (427)..(427): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggctnagtgtaaggtttccngcaaggcttcgtggatacaccttgcaagtcatgctcttctagttgggcgccgccgacgggccccccggagaacgggcttggagtggagtgggatggatacaacgactgaccaagtggtaatgactaaatacncggaccaagaaactcccgaaagggacaaggtacgttcgtaaaccgtttacgaacggggacacgacgtacccgngaacgtacgaggctaacgagttcggactgaggtcgacgttggtactcggtagaacgacgacggtactagtgttattacgtggtagtagtagtaagtaaggtaagggttggggtacttccgttcgtcccgttacggttacgttcgggtttcggggacccgtaacggggtcccgtggttaccgtaacccgttctaacccg

SEQ ID NO: 353802 - DNA, 631 bp, Homo sapiens
  misc_feature: GZ8MTXP01CDVC6.25.75.G09.1.454.CMB.2.raw
  modified_base (225)..(225): a, c, t, g, unknown or other
  misc_feature (225)..(225): n is a, c, g, or t
tcagactgtacagtcacgaccggtgctcgatttagtatagacatcaggggacccaacaaccacatccctcctcagaagcccccggagcacaactcctcaccatggactggacctggaggatcctctttttggtggcagcagccacaggtgcccactcccaggtccagcttgtgcagtcgtggggctggaggtgaagaagccgtggggcctcagtgaaggtttccngcaaggcttcgtggataccaccttcgacaagtcatgcttcttcagttgggtgccgcccgacgggccccccgagaacgggtcttggagtggatggggatggactacaacacgtgacctaaagtgggtaatcgaactaaactagtcccgacccaagtaactcccgagggaccagaacgtactaacggtttacgagggacacacgtcccgagagtaccgaggactacagtcggacctggtaggtcggccgttaggttactcgtaacggggaacgaccgtacggtacttagttacgtatttacgtggttgtagaagtactaggaacgggtggggactcgttcgtaccctggacccgttgggttcgggcccgtaggggtcccttgggcccttaccgtccgttaaccgtccg

SEQ ID NO: 353803 - DNA, 630 bp, Homo sapiens
  misc_feature: GZ8MTXP01DI8Q4.25.75.G09.1.454.CMB.2.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (321)..(321): a, c, t, g, unknown or other
  misc_feature (321)..(321): n is a, c, g, or t
  modified_base (350)..(350): a, c, t, g, unknown or other
  misc_feature (350)..(350): n is a, c, g, or t
  modified_base (495)..(495): a, c, t, g, unknown or other
  misc_feature (495)..(495): n is a, c, g, or t
tcagactgtacagtcacgaccggtgctcgatttagtatagacatcaggggacccaacaaccacatccctcctcagaagcccccagagcacaactcctcaccatggactggacctggaggattccttcttttttggtggcagcagccacaggtgcccactcccaggtccagcttgtgcagtcgtggggctgaggtgaagagcgtgggcctnagtgaaggtttcngcaaggtcttctggatacacttcgnaagtcatgctcttcagttgggcncgccgacggcccccgagaagggtcttggagtggagtgggatggatcaacncgtgaccaaagtggtaaatgacaaacttncgacctaagaaactcccgaagggaccaaggtattaccgaaacggttttacgaaggggtacacgtatcccgacgaagtaccgagaccttagaagtcggaaccgtggaagttcgaccgtaggtactacggtagaaaggcctacggtnttaatgttaattcggtagtgtagaacgtagtaacgtggggttaggggtacttcgttaccgtccgttacgccggttaagggttcgggggaccaacggggggttacccctgggttacccttaacccggttcctcccg

SEQ ID NO: 353804 - DNA, 556 bp, Homo sapiens
  misc_feature: GZ8MTXP01A7VCL.25.75.G09.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
  modified_base (396)..(396): a, c, t, g, unknown or other
  misc_feature (396)..(396): n is a, c, g, or t
  modified_base (470)..(470): a, c, t, g, unknown or other
  misc_feature (470)..(470): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagctgggcctnagtgagttcngcaggcttctgatacacttgcaagtcatgctntcatggncgcagccccganaggctgagtggatggatggatcaacnctgaccaagtggtaatgactaaactactcgaccaagaaactcccgaaaggggcaagacgtactacgtttacgtagggacacgtactccgacgagtacaggctanagtcggacctgacgtcgtacctgggtactcggtagtaacgacgacggtctagttgttacttagtgtgtagtagntaacgaggttgggacttcgtcgtcgttacgcgttacggtcggggaccgtaacggggtaccctgggttacctccggttcctaacccg

SEQ ID NO: 353805 - DNA, 599 bp, Homo sapiens
  misc_feature: GZ8MTXP01AN9IL.25.75.G09.1.454.CMB.2.raw
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (503)..(503): a, c, t, g, unknown or other
  misc_feature (503)..(503): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtgggcctcagtgaaggtttcctgcaaggtcttctggatacaccttcgacaagtcatgctcttcattggncgcacggccccganaggcttgagtggatgggatggatacgaacactgacctaagtcggtaatgacaaactactcgaccaagaaactcccgaaagggcaagacgtctaacgtttacgagggacacactccgacgaagtaacgacggacttaacgacgtacgggaccttaggaggtcggtccgtaggtacttcggtaaggaaacggtaccaacgggtcctaattgtaactttacgngtagtgaagtattaacgagggttggggacttcgtcgtccgcgacgttacggtcggggccgtaacggggaccctcgggttacctcccggttctcccg

SEQ ID NO: 353806 - DNA, 621 bp, Homo sapiens
  misc_feature: GZ8MTXP01DM5G9.25.75.G09.1.454.CMB.2.raw
  modified_base (207)..(207): a, c, t, g, unknown or other
  misc_feature (207)..(207): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtcgtggggctgaggtgaagagcgtgggcctnagtgaggttcctgcaaggtcttctgatacaccttgcaagtcatgctntnattggncgcacggcccganaggctgagngatggatgatnaacntgacaagtggtaaatgacaaactactcgaccaaagtaaactcccgaaagggcaagtacgtacgtaaaccgtttacgaagggactaacgacgtacccgagaacgtacgaggactaagagttcggactggagttcggaccttaggtactcggtaaggaacgaccgtaacggtcttaagttggttaatttaacgttggttaggtacgaaggtaagttaacggagggttagggggacttccgttacggttcccgacggttccgttaagggttccggggaccggaacggggtaccccgtgggttaccctaacccgttccgtaacccg

SEQ ID NO: 353807 - DNA, 708 bp, Homo sapiens
  misc_feature: GZ8MTXP01C7RG6.25.75.G09.1.454.CMB.2.raw
  modified_base (280)..(280): a, c, t, g, unknown or other
  misc_feature (280)..(280): n is a, c, g, or t
  modified_base (340)..(340): a, c, t, g, unknown or other
  misc_feature (340)..(340): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtcgcccactcccaggtccagcttgtgcagtcgtggggctggaggtagaaggaagccgtggggcctgagtgtaaggtttcctgcaaggtcttctggatacaccttcgacaagtcatgcttcttcagttgggnccgccgacgggcccccggaagaacgggcttaggaggtggagtggggatggatacgaaacnctgaccaagtggtaatgactaaactcgacgaccaagtaaaacgtccccggaaaagggcctaaggtaacgtaccgtaaaccggttttaacgaacggggaactaacgacgtaccgacggtaacgtaacgacggtactaacgaacgtcgggaaccttgggaacggttcggtccgttagggtaacttacggggttaaaggaaacgtaccgtaacgggtaccttaagttagttaactttaacgtggttagtaggacgttaaagtaacgggtagggttacgggggtacttcgttccgttccgttacggacccgttaagggttcgggggaccgaacgggggtaccctcgggttaccctaacccggttctaacccg

SEQ ID NO: 353808 - DNA, 658 bp, Homo sapiens
  misc_feature: GZ8MTXP01A9STW.25.75.G09.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
tcagactgtacagtcacgaccggtgctcgatttagtatagacatcaggggacccaacaaccacatccctcctcagaagccccagagcacaactcctcaccatggactggacctggaggatccttctttttggtggcagcagccacaggtgcccactcccaggtccagcttgtgcagtctggggctgaggtgaagagctgggcctnagtgagttcngcaagcttcngatacacttgcaagtcatgctcttcattgggncgccaggccccganagggctgagtggatggggactggatacgaaacacgtgacctaagtcggtaaatggacaaaacttcgacgacccaaaggtaaacctccccggaaagggtaccaaggtacgtaacccgtacgttttaaacgacggggaacacgtacgtaccgacgagaaccgaggacctaagacgtaggaccgtggaggttcggaccgttagtaacgtcgggtaaggaacggaaccacgggtacttaagttagttaacgtttacgttgttagtacggtagtaagttaacggaagggttcgggggaacttcggtccggtaccgttaccggaaccgttcgggttaaccgggggccgaacgggggttccccgtgggttcccgtaacccggttccgtaacccg

SEQ ID NO: 353809 - DNA, 566 bp, Homo sapiens
  misc_feature: GZ8MTXP01DIH9E.25.75.G09.1.454.CMB.2.raw
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (387)..(387): a, c, t, g, unknown or other
  misc_feature (387)..(387): n is a, c, g, or t
  modified_base (417)..(417): a, c, t, g, unknown or other
  misc_feature (417)..(417): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaaagtcatgctcttnattggncgccaggcccccganaagggcttgagtggatgggatggatacaacactgaccaatggtaatgcaaactatcgaccagaaaaccnccgaagganaagagtacgtaacgttacgaggacancgtccgagatacgagactaacagtcggacngagtgcgtagtatacgtagaagaacgacgtacgtatagttagttagtgtgtagtagtaagtaagtaggttagggtcgttcgtcgtccgttacgaccgttacggttcgggaccggtaacgggtaccgtcggttaccgtccgttccgtccg

SEQ ID NO: 353810 - DNA, 615 bp, Homo sapiens
  misc_feature: GZ8MTXP01C2FLK.25.75.G09.1.454.CMB.2.raw
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
tcagactgtacagtcacgaccggtgctcgatttagtatagacatcaggggacccaacaaccacatccctactcagaagcccccagagcacaactcctcaccatggactggacctggaggatcctctttttggtggcagcagccacaggtgcccactcccaggtccagcttgtgcagtcgtggggctgaggtgaagaagccgtggggcctcagtgaaggtttcctgcaaggcttcgtggatacaccttcgcaagtcatgctcttcattggncgccgacggcccccganaggcttgagtggagtggatggatacaacncgtgaccaagtggtaatgactaaactactcgaccaagaaacctcccgaaagggacaaggtacgtaccgtaacggttttacgacgggacacgacgtacccgagaacgtacgaggtctaacgagtcggactggagtcgcttaggtactcggtagaacgtacgacggtattagtgttaattagtgtacgtagagtagtaagtagggttggggacttccgttacgtcccgttacggttaccgttgggttcccgggggaccgtaacgggggtccctcgggttaccctcccggttcctaaccccg

SEQ ID NO: 353811 - DNA, 686 bp, Homo sapiens
  misc_feature: GZ8MTXP01D3EHI.25.75.G09.1.454.CMB.2.raw
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctgggctgaggtgaagagctggggctnagtgagttcctgcagtcttctggatacacttcgnaagtcatgctctcagttggncgccgacggccccggagaaggtcttagagtggatgggatggaatacaactactcgacctaagtggtaactgaactaaacttcgcggaaccaaggaaaaccctccccggaaaaggggcaaggacgttacccgtaaacggttttaacgaacggggacacgtaacgtcccggaacgtaacggtaacgacggtaccttaaacgaagttacgggtaacctggggaaccggttcgggtccgtaagggttactacgggtaacggaaacgtaccgtaacggttcttaacgttgtttaagttacgttggtacgtaggtaacgtagtaacgggtgggttcgggtacgttccgttacccggtccgttaccggttacggttacggggtcccggggaccggtccggggttacccgtcggttacccgtcccgttcctcccgg

SEQ ID NO: 353812 - DNA, 664 bp, Homo sapiens
  misc_feature: GZ8MTXP01D27AQ.25.75.G09.1.454.CMB.2.raw
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtcgtggggctgaggtgaagagcgtgggcctnagtgaagtttcngcaggtcttcgngatacaccttgcaagtcatgcttcttcagttgggcgaccgccgtaccgggacccccggaagtaacgggtcttggaggtggagttgggactggactacaacactcggaacctaaggttaggtaactgaactaaaacgttacgaccggaaccaaagtaaaacgtccccgaaagggaacctgggtaactaccgtaacgtttaacgacgggacacgtaacgcccgagtaaggtacaggtacaacgtagtcggtaactggagtcgtcttaggtacgtgtacgaagaccgtacggattaagttgttagtttacgtgttagtacggaagtaacgtaaggagggttacgggtcgttccgttaccgtccgttacggttaccggttcgggtccgggggacccgtaaccggggtaccgcgggttaccctccggttccgtcccg

SEQ ID NO: 353813 - DNA, 660 bp, Homo sapiens
  misc_feature: GZ8MTXP01BA1SJ.25.75.G09.1.454.CMB.2.raw
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (431)..(431): a, c, t, g, unknown or other
  misc_feature (431)..(431): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcagtgaaggtttcctgcaaggcttctggatacacttcgcaagtcatgctcttcattgggncgccgacggcccccgganaagggcttggagtggagtgggatggatacaacactggacctaaagtcgggtaaatcggaacaaactactacgaccaagaaactcccgaaagggacaagtacgtcctaaacgtttacaaggggacacgactccggacgaagtaacgnggtacctagacgttggaacccgttggacggtcgtccttagggttaactcggttacggaaacgtaccgaccgggtacttagtacgttaactttacgtggtagttaggagtagtaacgtaggggttggggtacgttccgttaccggttcccgttacggttaccggttaacgggttcgggggccccgtaacgggggtacccccgtgggttccccgtaacccggttctccccg

SEQ ID NO: 353814 - DNA, 789 bp, Homo sapiens
  misc_feature: GZ8MTXP01A50E3.25.75.G09.1.454.CMB.2.raw
  modified_base (227)..(227): a, c, t, g, unknown or other
  misc_feature (227)..(227): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtcgtggggctgaggtagaagagccgtggggcctgagtgtaacggtttccngacgaaggtcttgaggactaccaccttcgactaagtcatgtcttcttcgagttgggcgccgcccgacgggacccccgagaggtcttgagtggagtggatggactacaacacgtcgactaagttggtaaatcgaaactaaactcgtaccgaccaaggaaacctcccggaaaggtacaagggtcttaccgtaacgtttacgaagggaccacgtaccgaccgtacgaaggtaaccgaggtaacctacggtaacgttacggtaaccgtagggtaaccggttcgggtaccgtttagggtaaccgtttcggggtaaacgggaaacggtaccgtaccggtttacgttaaacggtttaagttacgtttaaaccggttggttaagggttaaccgtaaacggttaacggtaaagggtacgggggttacgggggtaacctttccggttacccccgtaaccggttaccgggttaaaccggttccgggggtttaaccgggggaccccgggttaacccggggggttaacccccttgggggttaaccccctccccggggttttcccgtaacccccgg

SEQ ID NO: 353815 - DNA, 694 bp, Homo sapiens
  misc_feature: GZ8MTXP01BWH9J.25.75.G09.1.454.CMB.2.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtcgcccactcccaggtccagcttgtgcagtcgtggggctgaggtgaagagcgtgggctnagtgagtttcngcaagtcttngatactaccttganaagtcatgtctcttcagttgggcgcgccgaccggcccccggagagggtcttggagtggagtgggatggaactacgaactacgtacgacctaaagttaggtaaactgaacctaaaacgtacgtaccggaacccaaagtaaaacctccccggaaaaggggacctaagggtaacgtttaaccgttaaaccgggttttaaacgtaacggggaacctaacgtacgttacccggacgtaacggtaacgacgggtacctaacgtacgtacgggtaccgtagggtacggtcggtaccgttagggttacttacgggtaaggaaacgtacgacggtattagttggttatttacgtagtgtagtagtgtggcggttagggtcgggacgtccgtacgttcccgttacgaccgttaagggtcggggaaccgtaccgggtaccgttcggtcccgttccgttcccg

SEQ ID NO: 353816 - DNA, 576 bp, Homo sapiens
  misc_feature: GZ8MTXP01BGER3.25.75.G09.1.454.CMB.2.raw
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (508)..(508): a, c, t, g, unknown or other
  misc_feature (508)..(508): n is a, c, g, or t
tcagactgtacagtcacgaccggtgctcgatttagtatagacatcaggggacccaacaaccacatccctcctcagaacgcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttcgtggatacaccttgcaagtcatgctctnattggngcgccacggccccganaggcttgagtggatggatggatacaactactgacctaagtggtaatgacaaacttcacgaccaagaaactccccgaaagggcctaaggacgtacctacgttttaacagggacacacgtccgacgagtacgagtctacgagtcgactgtagtcgacgtgtaactgtacgaagaccgtaggtactagttgtagttactgtagttgagaactaagaggttgggtacgngttccgtcttacggcttaggttcggggcgtaacggggtacccctggttccgtaacccgttcgtccccg

SEQ ID NO: 353817 - DNA, 582 bp, Homo sapiens
  misc_feature: GZ8MTXP01DUSAI.25.75.G09.1.454.CMB.2.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (451)..(451): a, c, t, g, unknown or other
  misc_feature (451)..(451): n is a, c, g, or t
  modified_base (488)..(488): a, c, t, g, unknown or other
  misc_feature (488)..(488): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagctggggcctcagtgaaggttcctgcaaggcttcnggatacaccttcgnaagtcatgctnttcattgggncgccaggcccccganaggcttgagtggagtggatggatacaactctgaccaagtggtaaatgacaaactagcgaccagaaactcccgaagggcaagagtctaacgtttacgagggacacgactccgagagtacaggactacgaagtcggactggagtcgactgtactaggtagaagtaccacggtnttagtgttaagttagtgttgtacgagtagttaagggngggttagggtcgttcgttacggtccgttacgttaccggttacggtcggggaccgtaacggggtacccgtcgggttaccgtaaccgttccgtccg

SEQ ID NO: 353818 - DNA, 590 bp, Homo sapiens
  misc_feature: GZ8MTXP01AKFLB.25.75.G09.1.454.CMB.2.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (321)..(321): a, c, t, g, unknown or other
  misc_feature (321)..(321): n is a, c, g, or t
  modified_base (345)..(345): a, c, t, g, unknown or other
  misc_feature (345)..(345): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtctggggctgaggtgaagagccgtgggcctnagtgaaggtttccngcaaggcttctggatacaccttcgcaagtcatgcttcttcattgggcncgccgacgggccccccgganaagggcttggagtggatgggatggatcaacntgacaagtggtaatgacaaactcncgaccaagaaactcccgaaagggcaagtacgtctacgtttacgaggacagctccgagagtacaggctacagtcgacctgagtcgccttagggtactcggtaggaacgtaccgtacggtacttagttgttaacttagtgtgtagtagtagtaacgtagggttggggacttcgtccggtccgttcggacgttcgggttcggggcccgtaacggggtacccctggttccctaaccgttcgtaaccccg

SEQ ID NO: 353819 - DNA, 567 bp, Homo sapiens
  misc_feature: GZ8MTXP01AZW1N.25.75.G09.1.454.CMB.2.raw
  modified_base (270)..(270): a, c, t, g, unknown or other
  misc_feature (270)..(270): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcgagtgaaggtttcctgcaaggcttctggatacaccttcgcaagtcatgctcttcattgggngcgccacggccccccgagaaggcttgagtggagtgggatggatcaacactgaccaagtggtaaatcgacaaactacgtcgaccagaaactccccgaaagggccaagacgtcacgtttacgagggacacactccgacgagtacaggctacagttacggactgaggtgccgtaggtatcgtagaacgcgaacggtctagtgtattacngttagngtagntaacgnggttgggacncgtacgtccttacgcttaggttcggggccaacggggtacccctgggttcctaaccgttcgtccc

SEQ ID NO: 353820 - DNA, 742 bp, Homo sapiens
  misc_feature: GZ8MTXP01EOVRA.25.75.G09.1.454.CMB.2.raw
  modified_base (220)..(220): a, c, t, g, unknown or other
  misc_feature (220)..(220): n is a, c, g, or t
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcagtgagtttccngnagtcttcnggatacncttcgnaagtcatgcttcttcagttgggngcgcccgacgggccccccggagaacgggcttaggaggtggagtgggattgggaactacgaaactacgtcgacctaaagtggtaaatcgaaactaaactacgtcgaccaaagaaacctcccggaaagggcaagtacgtacgtaacgtttaacgtacgggacacgtacgtacccgagtaagtaccgaggtacctaataacgtacgggtaccttgggacgttcgggaccgtttagggtaacttaccgggttaagggaaacggtaaccgtaccggggtactttaaacgttcggtttaaacttttacggtggttagggttaacggtaaacggtagttaaaccggggttagggttaacggggggtaccttcccggttcccgttacccgggttaccgttaccggttacggggtttccccggggggaccgttaacccgggggtcccgttcggggttaccctaaccccgggttcttaacccccgg

SEQ ID NO: 353821 - DNA, 677 bp, Homo sapiens
  misc_feature: GZ8MTXP01BR797.25.75.G09.1.454.CMB.2.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (288)..(288): a, c, t, g, unknown or other
  misc_feature (288)..(288): n is a, c, g, or t
  modified_base (320)..(320): a, c, t, g, unknown or other
  misc_feature (320)..(320): n is a, c, g, or t
  modified_base (345)..(345): a, c, t, g, unknown or other
  misc_feature (345)..(345): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaagtttcngcaaggcttcnggatacaccttcgcaagtcatgctcttcagttgggtgcgcccacgggccccccgganaacggcttggagtggagtgggatggatcaacncgtgaccaagtgtaatgacaaactncgacagaaactccgaagggcaagactactacgttacgtagggacagtacgtccgagtacgtacgaggtctaactacggtcggtaaccgtggacggttcggacccgttaggggtacttacgggaggtaaacggacccgtaacgggtctttaagttagttaacgtttaaacgttggttaggtacggtaaacgtagttaaaccgggtaggggttacgggggtaaacttcccgttaccgggttaccccttacgggaaccggttaacgggttccggggggaccccgttaacgggggttaccccgtgggtttaccccgcccgtttaacccggtccccg

SEQ ID NO: 353822 - DNA, 638 bp, Homo sapiens
  misc_feature: GZ8MTXP01EJ17Z.25.75.G09.1.454.CMB.2.raw
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (248)..(249): a, c, t, g, unknown or other
  misc_feature (248)..(249): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtcgcccactcccaggtccagcttgtgcagtcgtggggctgaggtgaagagccgtgggctcagtgagttcngcagctngatacnctgcagtcatgctntnntggncgcncggcccganaggntgngtgngtggatggatacaacncgtgaccaagtcggtaaatgactaaactatccgacctaagaaacctccccgaaagggacctaaggtacgtaccttaacggtttacgtaacggggactacgtacgtccgacgacgtaacgaggctaacagtacggtaacgtgtaggtcgtccgttgtactcgggttacgaagaaccgtccgggtaattaggttagttaacgtttaacgtggtaagttaggtaagtagtaaccggtagggttacggggacgttcgttcccggtacgttacccggttccgttacgggttccgggggacggtccgggggtaccccgttcggggttaccctccccggtttccgtccccgg

SEQ ID NO: 353823 - DNA, 642 bp, Homo sapiens
  misc_feature: GZ8MTXP01CGE0Y.25.75.G09.1.454.CMB.2.raw
  modified_base (224)..(224): a, c, t, g, unknown or other
  misc_feature (224)..(224): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctggaggtgaagaagccgtggggcctcagtgaaggtttccngcaaggtcttctggatacaccttcgacaagtcatgctcttcagttgggngcgccgacggcccccgganagggcttggagtggagtggatggatcaactctgaccaagtggtaaatgactaaacgtctcgaccaagaaacctcccggaaagggcaaggacgtaccgtaacggtttacgacggggacacgtactcccgagtacgtacgacggtactaacgtagtacgggtacctgggaggtcgggtccgttgggttaacttcggggtaaggaacggtaccgacgggttacttagttcgttatttacgtgttggtagatagtaaggtaggttgggggacttccgttacggtccttcggaccgttagggttccgggggaccgtaacgggggccccgttgggttaccctcccggttcctcccg

SEQ ID NO: 353824 - DNA, 638 bp, Homo sapiens
  misc_feature: GZ8MTXP01B0IGD.25.75.G09.1.454.CMB.2.raw
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtcgtggggctgaggtgaagagccgtgggcctgagtgaagttcngcaaggcttcgnggactactaccttcgcaagtcatgctcttcagttgggcgcggaccgaccgggccccccggagaaggggtccttggaggttggatggggatggactcaacnctagaccaagtggtaangtacaaactactacggaccaagaactcccgaagggacaaggtacgtacgtacggtttaacacgggacacgtactccgagtaacgtagacggacctaagacgtacgggtacctggtacgtcgggtaccctagggttactcggtaaggaaacgtaccgacggtacttaagttacgttaagtttagtaggttagtacgtaggaattaacggaagggttcgggggacttcgtaccgtccgttacggccttagggttcgggaccgcggggtaccctggaccctcgttccgtcccg

SEQ ID NO: 353825 - DNA, 652 bp, Homo sapiens
  misc_feature: GZ8MTXP01DK0IO.25.75.G09.1.454.CMB.2.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaaggaagccgtggggcctnagtgtaaggtttccngcaaggcttctggatacaccttcgacaaagtcatgtctcttcagttgggncgcccagggcccccganaagggcttagagtggatgggactggaatcaatctgacaagtggtaaatgacaaactcngaccaanaaactcccgaaagggcaagacgtctaaacgtttacgaggaacacgactacgacgaagtacgaggtactaagacgttacgaacgtgtacggcgtacttgggttaatacgtaggaaaacggtaccgaaccgggtacttaaagttggttaactttaagtggtttaagagtaagtacgttaaaggaagggtttgggggaacttccggttaccggtcccgttaacgggttaacccgttagggttccgggggaaccgtaacggggtacccgtacgggttacctaacccgttcgtaaccccg

SEQ ID NO: 353826 - DNA, 745 bp, Homo sapiens
  misc_feature: GZ8MTXP01EFRTO.25.75.G09.1.454.CMB.2.raw
  modified_base (218)..(218): a, c, t, g, unknown or other
  misc_feature (218)..(218): n is a, c, g, or t
  modified_base (269)..(269): a, c, t, g, unknown or other
  misc_feature (269)..(269): n is a, c, g, or t
  modified_base (347)..(347): a, c, t, g, unknown or other
  misc_feature (347)..(347): n is a, c, g, or t
  modified_base (487)..(487): a, c, t, g, unknown or other
  misc_feature (487)..(487): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcgtggcctgagtgtagtttccngacagtcttctgactacaccttgacaagtcatgcttcttcgagttgggtcncggccgacggtccccgacggaggtcggtcgtaggtggtgtaggtgtagagtactacagtacgtacgaacgtaggttanaacgtcaaaacgttaacttacggacctaaagaaacgtaccccgaacgggtaccgaagtacgttaccgtaacgtttaaccggttacggacgtaacactaccggtgaaccggacgacgtacgactaacgttcggacgtacgnggtcgggtacgttacggtagttacgtacggtaacgaaacgggtacccgtagtttaacggtatttaggtttaaacccgtttggttaggggttagtaaacggtaaccgttaacggttacggggttggggggtaaacgtttcggtcccggttttaacccggacggttaacccgggttaacgggtttcgggggtaccccgggggtaaacccgggttcccggggtccggttacccgtttaaccccgccccgggtttttccccc

SEQ ID NO: 353827 - DNA, 858 bp, Homo sapiens
  misc_feature: GZ8MTXP01BINI6.25.75.G09.1.454.CMB.2.raw
  modified_base (207)..(207): a, c, t, g, unknown or other
  misc_feature (207)..(207): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtgggcctnagtgaaggtttcctgcaaggcttcgtaggatactaccttcgacaagtcagtgtcctcttcgattgggcgcgcccgacgggtccccccgagaacgggcttggacggtggagtgggattgggactacaaacgcgtcgaacctaaagtacggttaaatcggaactaaaacgttacctaccggacccgtaaaagtaaaaccgtccccggaaaagggaccctaagggtacgtttaacccgttaaaccgggttttaaccgaacgggggttaaccaaccgtaaccggttacccggaacggtaaacgggttaacccgaaacgggtacccttaaacgaacgggttaccgggtaaacccgttagggaaacgggttccgggtacccgttaagggttaaccgttaccgggtaaagggttaaaccgggaaaccgtaacccggggttactttaaacgtttcgggttaaattttaaacccgggttggtacgggtttagggaaacggttaaagggttaacggtaaagggggtttcgggggaaacttcccggttaccgggtttaccccgttccgggttaacccggttaggggttaacccggggggcccggtaaaccgggggtttcccccgtacgggttccccgttaacccgggttccccgttccccgg

SEQ ID NO: 353828 - DNA, 691 bp, Homo sapiens
  misc_feature: GZ8MTXP01AVOL7.25.75.G09.1.454.CMB.2.raw
  modified_base (336)..(336): a, c, t, g, unknown or other
  misc_feature (336)..(336): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgtaaggtttcctgcgaaggtccttcgtaggactacaccttcgcaagtcatgcttactgagtgggtgcgccgacggcccccggaagaacggtcttggagtggacgtgggactggactacgaaacncgtcgacctagtaggtaactggaactaaacgttacgaccgaccgaagtaaactcccggaaagggtacaaggtacgtactaacggtttacgaagggacctaacgcgtccgacgtagtaacgaggacctacgaagtcgaccgtgtaacgggttcggaccttaggaacgtcggtaaggtaaacggtaccgtaccgggtaattattcgggttaaattaccggttgttccgggtagtagtaacggtaagtaaggggttcggggtacgcccggttacccgtccgttcggacccgttaggggttccggggtacccggtaacggggtaaccccgtcgggttacccgtaacccgttcgtccccg

SEQ ID NO: 353829 - DNA, 540 bp, Homo sapiens
  misc_feature: GZ8MTXP02GSPV8.25.75.G09.1.454.CMB.2.raw
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccggacaagggcttgagtggatgggatggatcgaacactgccaatggtaaatgacaaactatgcccagaaactcccgagggcagagtcacgttactagggacacatccgagagtacaggctacatggacctgagtgcctggtatctagaagacacggctagtgtattactgtgtgagatacgaggttggggatcgtacgtcccgtacgacccgtagttcgggggccgtacgggggaccctgggtcccgtaccggtcctccccg

SEQ ID NO: 353830 - DNA, 546 bp, Homo sapiens
  misc_feature: GZ8MTXP02JN4U6.25.75.G09.1.454.CMB.2.raw
  modified_base (266)..(266): a, c, t, g, unknown or other
  misc_feature (266)..(266): n is a, c, g, or t
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
  modified_base (402)..(402): a, c, t, g, unknown or other
  misc_feature (402)..(402): n is a, c, g, or t
tcagactgtacagtcacgaccggtgctcgatttagtatagacatcagggacccaacaaccacatccctcctcagaagcccccggagcacaactcctcaccatggactggacctggaggatcctcttttggtggcagcagccacaggtgcccactcccaggtccagcttgtgcagtctggggctgaggtgaagaagccgtgggcctcagtgaaggtttcctgcaaggcttctggatacaccttcgcaagtcatgctcttcattggtncgccacggcccccgganaaggcttgagtggatgggatggatcaacactgaccaagtggtaatgacaaactatcgacccagaaactcccgaggcagngtcacgtttactagggacacatccgacgagtacaggctanagtaggacctgagtgccgtggtatcgtagaagacacggctagtgtattacgtgtgtagagtatacgaggtgggagtctacggtccgtcgaccgtagttcggggccgacggggtacccctggtccgacccgttcgtcccgtaccg

SEQ ID NO: 353831 - DNA, 543 bp, Homo sapiens
  misc_feature: GZ8MTXP02F2MJA.25.75.G09.1.454.CMB.2.raw
  modified_base (283)..(283): a, c, t, g, unknown or other
  misc_feature (283)..(283): n is a, c, g, or t
  modified_base (482)..(482): a, c, t, g, unknown or other
  misc_feature (482)..(482): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccgganaagggctgagtgatgggatggatcaacactgccaatggtaaatgacaaaactatgaccccaagaaaactccccaaggggcaggagtcaacggtttaccaggggaacacatcccgacgagtacaggctacatggacctgagtgcctggtatctgaagacacgggctaatgtattactgtgtgtagatacgaggtggggancgtcgtcctacggacctagttcgggggcccaagggggaccctgggtccaccggttctcccg

SEQ ID NO: 353832 - DNA, 504 bp, Homo sapiens
  misc_feature: GZ8MTXP02IVO5C.25.75.G09.1.454.CMB.2.raw
  modified_base (211)..(211): a, c, t, g, unknown or other
  misc_feature (211)..(211): n is a, c, g, or t
  modified_base (219)..(219): a, c, t, g, unknown or other
  misc_feature (219)..(219): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctgggctgaggtgaagagctgggctcagtgagttcngcagctcngatacactcgcaagtcatgctcttcattgggtgcgccaggcccccganagggctgagtggatgggatggatcgaacactgccaatggtaaatgacaaactntgacccagaaactccaggcagatcacgtttacagggacacatccgngagtacaggctanatggactgagtgctggtatctagaagacagggctatgtattacgtgtgtagagatacgaggtgggggactcgtcgtcctacgaccagttcggggcccaaggggaccctggtccaccggttctccg

SEQ ID NO: 353833 - DNA, 561 bp, Homo sapiens
  misc_feature: GZ8MTXP02JTXE7.25.75.G09.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (482)..(482): a, c, t, g, unknown or other
  misc_feature (482)..(482): n is a, c, g, or t
  modified_base (551)..(551): a, c, t, g, unknown or other
  misc_feature (551)..(551): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccacggcccccgganagggcttgagtggatgggatggatcaacactgccaatggtaaatgactaaaactatacgaccccaagaaaactcccccgaaggggccaggacgtacctaacggttttaccgaaggggaaccacgactcccgcgagtaccaggctaacgagtggacctgagtgcctggtatcgtagagacgacggctatgtattacgngtgtgagatacgaggtggggatcgtcgtcctcgaacctggttcggggccgacgggggccctgggtaccnccggtctccg

SEQ ID NO: 353834 - DNA, 671 bp, Homo sapiens
  misc_feature: GZ8MTXP02JG378.25.75.G09.1.454.CMB.2.raw
  modified_base (204)..(204): a, c, t, g, unknown or other
  misc_feature (204)..(204): n is a, c, g, or t
  modified_base (282)..(282): a, c, t, g, unknown or other
  misc_feature (282)..(282): n is a, c, g, or t
  modified_base (339)..(339): a, c, t, g, unknown or other
  misc_feature (339)..(339): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagagcctgggcctnagtgaaggtttcctgcaaggcttctggatacaccttcgcaagtcatgctcttcattgggtgcgccacggcccccgganaagggcttgagtggatgggatggatcgaacactgccaaatggtaaatgacaaaactntcgacccaagaaactcccgaaggggccaggacgtactaaccggttttacgaagggggaccacgaacgtcccgacgtaacgtaccgagggaccttaacgattcggggaacccttgggaacggttcgggcccttaggggttaacttccgtagggaaacgaccgaacgggtaccttagttaggttaatttaccgttggtaggttcgtaaaaggattaaacggagggttagggggaactccgttaccgggttccctaccggaaccgtaacggttcgggggacccgaacggggggtacccccttggggtacccgtaaccccggttccgttacccccg

SEQ ID NO: 353835 - DNA, 566 bp, Homo sapiens
  misc_feature: GZ8MTXP02IT6QH.25.75.G09.1.454.CMB.2.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccganaagggctgagtggatgggatggatcaacactgccaatggtaaatgacaaactatcgacccagaaactcccgagggcagagtcacgtttacagggacacatcccgagagtacaggctacgatcggacctgacgtggcctaggtactcgtaggaagacgacgggtctaagtggttaattactggttgtacgaagacttaacgagggtggggacgcttacgtccctacgacccgtaaggttcgggggacccgtacgggggaccccttgggtccacccggttctcccg

SEQ ID NO: 353836 - DNA, 560 bp, Homo sapiens
  misc_feature: GZ8MTXP02I6GFO.25.75.G09.1.454.CMB.2.raw
  modified_base (280)..(280): a, c, t, g, unknown or other
  misc_feature (280)..(280): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagagcctgggcctcagtgaaggtttcctgcaaggcttctggatacaccttgcaagtcatgctcttcattgggtgcgccaggcccccgganaagggcttgagtggatgggatggatcaacactgccaatggtaaatgacaaactatgacccagaaactcccagggcagagtcacgtttacagggacacntccgcgagtaacncgggactacagngacgtagagtgcgtggtacgtcgtagaagacgacggtacgtagtagttacgttacgttagttggtagtagtagtacgtaggtaggggacggtcgtacgtccgtccgaccgtacggtcgggccggaccgggacccgtacggtccgtaccgtccgtccg

SEQ ID NO: 353837 - DNA, 615 bp, Homo sapiens
  misc_feature: GZ8MTXP02IEHPR.25.75.G09.1.454.CMB.2.raw
  modified_base (285)..(285): a, c, t, g, unknown or other
  misc_feature (285)..(285): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaagtttcctgcaaggcttctggatacaccttcgcaagtcatgctcttcattgggtgcgccacggcccccgganaagggcttggagtggagtgggatggatcgaaacactgaccaagtggtaaatggactaaaactactacgaccccaagaaactcccgaaggggcaggacgtactaaccgtttaacgtaacggggacacacgtacccgacggaacgtaacgaggtaccttaaccgagttacgggaccttaggaacgtcgggtccctagggttaattccgtaggaaacgaccgaacgggcttagtagttattagtgtagtgagtactacgaggtggggatccgtcgtacctcggtaccaggttcggggccgaacggggtccctggtcccgtaccgtccgtcccg

SEQ ID NO: 353838 - DNA, 534 bp, Homo sapiens
  misc_feature: GZ8MTXP02IVTID.25.75.G09.1.454.CMB.2.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
  modified_base (381)..(381): a, c, t, g, unknown or other
  misc_feature (381)..(381): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagagcctggggcctcagtgagttcctgcaggcttnggatacaccttcgcaagtcatgctcttcattgggtncgccaggcccccgganagggctgagtggatgggatggatcaacactgccaatggtaaatgacaaactatcgcccaagaaactcccgagggcagagtcacgtttacagggacacatccgngagtacaggctacatggacctgagtggctggtatcgtagagacaggctagtgtattactgtgtagagatacgagggtggggactcgtcgtccgtacgacccgtaggttcgggggaccctacgggggtacccctgggtcccaccggttctcccg

SEQ ID NO: 353839 - DNA, 534 bp, Homo sapiens
  misc_feature: GZ8MTXP02JP6KN.25.75.G09.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
  modified_base (386)..(386): a, c, t, g, unknown or other
  misc_feature (386)..(386): n is a, c, g, or t
  modified_base (439)..(439): a, c, t, g, unknown or other
  misc_feature (439)..(439): n is a, c, g, or t
  modified_base (477)..(477): a, c, t, g, unknown or other
  misc_feature (477)..(477): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctctcattgggtncgccaggcccccgganaagggcttgagtggatgggatggatcaacnctgccaaatggtaaatgacaaactatgacccagaaatcccagggcagagtcacgtttacagggacacatccgngagtacaggctacgatcgggacctgagtggcctggtatcgtgaagacacgggntagtgtattactgtagtgagacttacgagtgggggacnctcggtcctacgaccagttcggggaccaacgggggcccctggtccaccgtcttcccg

SEQ ID NO: 353840 - DNA, 611 bp, Homo sapiens
  misc_feature: GZ8MTXP02HO6HW.25.75.G09.1.454.CMB.2.raw
  modified_base (284)..(284): a, c, t, g, unknown or other
  misc_feature (284)..(284): n is a, c, g, or t
  modified_base (556)..(556): a, c, t, g, unknown or other
  misc_feature (556)..(556): n is a, c, g, or t
tcagactgtacagtcacgaccggtgctcgatttagtatagacatcaggggacccaacaaccacatccctcctcagaagccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccgganaagggcttgagtggatgggatggatcaacactgccaatggtaaatgacaaaactatacgaccccaagaaaactcccgaaggggacaggaacgtctaaccgttttacgaaggggaccaacaacgtcccgacgaagtaaccacgggaccttaaccgagttcggggaacccttgggaacggttcggggtacccttagggttactccgttaggaaagaccgacgggacttaatggtaattacgttggtagttggaagagttacgaggttggggacncgtcgtcctcgacctagttaacggggcacgggggaccctggtccaccgtctcccg

SEQ ID NO: 353841 - DNA, 723 bp, Homo sapiens
  misc_feature: GZ8MTXP02G18O7.25.75.G09.1.454.CMB.2.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (283)..(283): a, c, t, g, unknown or other
  misc_feature (283)..(283): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctgggcctnagtgaaggtttccngcaaggcttctggatacaccttcgcaagtcatgctcttcattgggtgcgccaggcccccgganaagggcttgagtggatgggatggatcgaacactgccaatggtaaatgacaaactactgaccccaagaaactccccgaaggggaccaggagttacctaacgttttaaccgtaagggggaaccacgactacccggacgaaggttacgagggaccttaaccgaagttcgggaacccttaggaacggttcgggtccccgttaggggttacttaccgttaggtaaaacggaccgaacggggtaccttaagttaggttaattttaacgttggttaggtttacggaaggtaaacgtttaaacggaaaggggtttggggggaaacgtcccggtttaccggttccccgttacccggaaccccgttaagggtttccggggggaccccgtaaaacggggggtacccccgttcggggtaccccgtaaccccgggtttaccgtttaccccccg

SEQ ID NO: 353842 - DNA, 750 bp, Homo sapiens
  misc_feature: GZ8MTXP02HSCWS.25.75.G09.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccacggcccccgganagggcttgagtggatgggatggatcgaacactgaccaatggtaaatgacaaaacgtactacgaccccaagaaaactcccgaaggggccaggagttacctaacggttttaccaaacgggggacaaaccgtacgtacccgacggtaacgtaccaacgggtctaaacccgtagtacgggaacccgttgggaacggtcgggtacccgttagggttaacttccgttaggaaaacggtaacccgaacggggtaccttaaagtttacgggtttaaacttttaacgttagggttcggtttaagggaaacgtaagtttaaaccggaagggggtttaggggggaaaccggttccggttaacccgggttcccgttacccggggtaaccccgtaggtttaaccggggggcccggtaaaccggggggtaccccccgttacgggggttccccgtaacccggggttccctttacccccgg

SEQ ID NO: 353843 - DNA, 533 bp, Homo sapiens
  misc_feature: GZ8MTXP02J1QNY.25.75.G09.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccgganaagggcttgagtggatgggatggatcaacactgccaatggtaaatgacaaaactatcgacccagaaaactcccaggggcagagtcacgtttacaggggacacatccgcgagtacaggctacatggacctgagtggcctgggtatcgtagaagacacgggctatgttattactgtgtgagatacaggtggggatcgtcgtcctcgacccagttcggggccagggggacccctgggtccaccggttctcccg

SEQ ID NO: 353844 - DNA, 608 bp, Homo sapiens
  misc_feature: GZ8MTXP02GI5I1.25.75.G09.1.454.CMB.2.raw
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccggacaagggcttgagtggatgggatggatcaacactgccaatggtaaatgactaaaactactgaccccaagaaaactccccgaaggggccaggagtacctaacggttttaaccgaagggggtaaccacaacgtcccgacgaagtaccaagggcctaacgatcggggaaccttggaacgtggcccttagggttatccgtaggaaacgacacgggcttaagtgttatttactggttgtagtaagatacgtaggtagggggactcgtcgtccgtacgaccgtaggttcgggggaccgacgggggtacccctggtaccacccggttctcccg

SEQ ID NO: 353845 - DNA, 537 bp, Homo sapiens
  misc_feature: GZ8MTXP02G8OQV.25.75.G09.1.454.CMB.2.raw
  modified_base (284)..(284): a, c, t, g, unknown or other
  misc_feature (284)..(284): n is a, c, g, or t
tcagactgtacagtcacgaccggtgctcgatttagtatagacatcaggggacccaacaaccacatccctcctcagaagcccccagagcacaactcctcaccatggactggacctggaagatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccgganaagggcttgagtggatgggatggatcaacactgccaaatggtaaatgacaaaactatgaccccaagaaaactcccgagggcagagtcaacgtttacagggacacatccgagagtacaggctacatggacctgagtgcctggtatctagagacacgggctatgtattacgtgtgtagagatacgaggtggggatcgtcgtccgtcgaccgagttcgggggaccctacgggggaccctggtccaccggtctcccg

SEQ ID NO: 353846 - DNA, 587 bp, Homo sapiens
  misc_feature: GZ8MTXP02GRJ84.25.75.G09.1.454.CMB.2.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttccngcaaggcttctggatacaccttcgcaagtcatgctcttcattgggtgcgccacggcccccgganaagggcttgagtggagtgggatggatcgaacactgaccaagtggtaaatgactaaactatacgacccaagaaactcccgaagggcaggacgtacctaaacgtttaacgaggggaacaacgacgtacccgacgaagtacaggactaacgagtcggacctaggagtcggcctaggtactcgtagaagacgacgggtactaagtgtattagtgtgtagtagacgtacgaggtaggggactcgttcgtccgtacgaccgtaggttcggggacgacggggtaccctggtaccgtaccgtcgtcccg

SEQ ID NO: 353847 - DNA, 562 bp, Homo sapiens
  misc_feature: GZ8MTXP02I9PXY.25.75.G09.1.454.CMB.2.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctnagtgaaggtttcctgcaaggcttctggatacaccttcgcaagtcatgctcttcattgggtgcgccaggcccccgganaagggcttgagtggatgggatggatcgaacactgccaagtggtaaatgacaaactatcgacccaagaaactcccgaagggcagacgtactacgtttacgagggacacagtccgacgagtacaggactacgatcggactgagtggccttggtactcgtagaacgacgacgggtactaagtgttaattacgtgttgtagagattacgaggtggggactctcggtcctacggacctagttcgggggccgacgggggtaccctggtccacccggtctcccg

SEQ ID NO: 353848 - DNA, 540 bp, Homo sapiens
  misc_feature: GZ8MTXP02JWBS7.25.75.G09.1.454.CMB.2.raw
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (343)..(343): a, c, t, g, unknown or other
  misc_feature (343)..(343): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccgganaagggcttggagtggatgggatggatcaacnctgaccaatgggtaaatgacaaaactntcgacccagaaactcccgagggcagagtactacgtttacagggacacatccgcgagtacaggctagatcggacctggacgttgcctgggtactcgtagaagacacggctatgtattagtgtgtgacgntacgnggtggggatctcgtcctacgacctaggtcggggcctagggggaccctggtccgaccgtctcccg

SEQ ID NO: 353849 - DNA, 600 bp, Homo sapiens
  misc_feature: GZ8MTXP02I4JV3.25.75.G09.1.454.CMB.2.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccacggcccccgganagggcttgagtggatgggatggatcaacactgccaagtggtaaatgacaaactatcgacccaagaaactcccgaaggggcaggagtacgtaacggtttacgaggggacacacgtcccgacgtaagtacgaggactaacgagtcggacctggagtcggccttagggtacttcgtagaacgacgacgggtacttaagtgttaacttacgtgtgttagaagtagtacgagggtggggactcgttcgtcccgtacgtaaccgtacggttcgggggaccgtacgggggtacccgtaggtacccacccggttctaccccg

SEQ ID NO: 353850 - DNA, 611 bp, Homo sapiens
  misc_feature: GZ8MTXP02I5W4D.25.75.G09.1.454.CMB.2.raw
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccgganagggctgagtggntgggatggatcaacactgccaatggtaaatgactaaactatcgacccagaaaactccccgaaggggccaggacgtaccgtaacggttttaccgtaggggaaccacgaatcccgacgtaaacgttaacgaacgggaccttaaccgaagttacggggacccttagggaacggttcgggacccttaggggtaacttccgttaggaacgaccgacgggtacttagtgttaattacgtagtgtagagtatacgaggtgggggatcgttcgtcctcgacctaggttcggggaccaggggtaccctggtccaccgtctccg

SEQ ID NO: 353851 - DNA, 541 bp, Homo sapiens
  misc_feature: GZ8MTXP02JY4UR.25.75.G09.1.454.CMB.2.raw
  modified_base (280)..(280): a, c, t, g, unknown or other
  misc_feature (280)..(280): n is a, c, g, or t
  modified_base (382)..(382): a, c, t, g, unknown or other
  misc_feature (382)..(382): n is a, c, g, or t
  modified_base (479)..(479): a, c, t, g, unknown or other
  misc_feature (479)..(479): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagagcctggggcctcagtgaaggtttcctgcaaggcttctggatacaccttcgcaagtcatgctctcatgggtgcgccaggcccccgganaagggcttgagtggatgggatggatcaacactgccaatggtaaatgcaaaatctgcccagaaactcccagggcagagtcacgtttacagggacacatcccgngagtacaggctacatggaccttgagtcgggcctagggtacttcgagaagacaccgggtatagtagttaattcgtgtagtagagtacgtacgtagggngggacgcgtcgtccgacgtacgtaggtcggggaccgacgggtcctcggtaccaccgtctccg

SEQ ID NO: 353852 - DNA, 536 bp, Homo sapiens
  misc_feature: GZ8MTXP02IOY2F.25.75.G09.1.454.CMB.2.raw
  modified_base (284)..(284): a, c, t, g, unknown or other
  misc_feature (284)..(284): n is a, c, g, or t
  modified_base (392)..(392): a, c, t, g, unknown or other
  misc_feature (392)..(392): n is a, c, g, or t
  modified_base (430)..(430): a, c, t, g, unknown or other
  misc_feature (430)..(430): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggtgcgccaggcccccgganagggcttgagtggatgggatggatcaacactgccaatggtaaatgacaaactatcgacccaagaaaactcccgaggcaggagtcaacgtttacaggggacacatccgngagtacaggctacatcggactgagtggactggtatcgngaagacacggctatgtattacgtgtgtgagatacgaggtggggatccgtcgtcctcgacctaggttaacgggcgacgggggtaccctggtcctaccggtctacccg

SEQ ID NO: 353853 - DNA, 715 bp, Homo sapiens
  misc_feature: GZ8MTXP02JD4YM.25.75.G09.1.454.CMB.2.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcagttgggtncgccacggcccccgganaagggcttgagtggatgggatggatcaacnctgaccaagtggtaatgactaaactatcgacccaagaaactcccgagggcagacgtacgtaacgttttaacgacggggaacaacgacgtacccgacgtaaaggttaaccgaacgggtaccttaaacgacgttacgggaaaccccgtgggtaacgggttcgggccccgttaggggttaacttacggttaacggaaacggaaccgtaacggggtaccttaaggttacggttaactttaacggttggttagggttaggtaacggtaattaaccgggtaaggggttgggggaaacgtccgttacccgggtcccgttaccggaacccgttaacgggttccgggggaaccccggtacgggggtaccccgttcggggtacccgtaacccgggttcctttaccccgg

SEQ ID NO: 353854 - DNA, 548 bp, Homo sapiens
  misc_feature: GZ8MTXP02GKHCW.25.75.G09.1.454.CMB.2.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttccngcaaggcttctggatacaccttcgcaagtcatgctctcattggtncgccaggcccccganaggcttgagtgatggatggatcaacactgccaagtggtaaatgacaaactatcgacccaagaaactcccgaggggcagacgtctaacgtttacgagggacacactccgacgagtacaggctacgatcggactgagtcggacctgggtactcgtagaagacgacgggtctagtgtattacgtgtgtagagtatacgagggtggggagtcgtacgtccgtacggacctaggtcggggccgtacggggacctggcctaccggtctcccg

SEQ ID NO: 353855 - DNA, 543 bp, Homo sapiens
  misc_feature: GZ8MTXP02FPAD5.25.75.G09.1.454.CMB.2.raw
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (401)..(401): a, c, t, g, unknown or other
  misc_feature (401)..(401): n is a, c, g, or t
  modified_base (485)..(485): a, c, t, g, unknown or other
  misc_feature (485)..(485): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttccngcaaggcttctggatacaccttcgcaagtcatgctcttcattgggtncgccacggcccccgganaagggcttgagtggatgggatggatcgaacactgccaaagtggtaaatgacaaactatcgacccaagaaaactcccgaagggacaggacgtcaacgtttacagggacacatccgngagtacaggctacatcggactgagtgcctggtatcgtagaagacacggctagtgtatacgtgtgtgagatacgaggtggggacncgtcgtcctacgacctaggttcgggccgacgggggtaccctggtccaccggtctcccg

SEQ ID NO: 353856 - DNA, 630 bp, Homo sapiens
  misc_feature: GZ8MTXP02JMHS2.25.75.G09.1.454.CMB.2.raw
  modified_base (206)..(206): a, c, t, g, unknown or other
  misc_feature (206)..(206): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (566)..(566): a, c, t, g, unknown or other
  misc_feature (566)..(566): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagagcctggggcctnagtgaaggtttcctgcaaggcttctggatacaccttcgcaagtcatgctcttcattgggtncgccacggcccccgganaagggcttgagtggatgggatggatcaacactgccaatggtaaatgacaaactatgacccaagaaaactcccgaagggcaggacgttacgaaccggtttttaacgaagggggaacaacgtacgtccccggacgaaacggtaaccgagggacttaaccgaagttacggggaacccttggaacggttcgggaccctttaggggtaacttccgttaggaaacgaccgacgggtacttaagtggttaatttacgtggttgtagagagttacgagggttgggggacncgttcgtccgtacgaccgtagttcggggaccgacggggtaccctgggtacctaccggtctcccg

SEQ ID NO: 353857 - DNA, 643 bp, Homo sapiens
  misc_feature: GZ8MTXP02FTIMV.25.75.G09.1.454.CMB.2.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctgggctgaggtgaagagcctgggcctcagtgaaggtttcctgcaaggcttctggatacaccttcgcaagtcatgctcttcattgggtncgccaggcccccganaagggcttgagtggatgggatggatcaacactgaccaagtggtaaatgacaaactatcgacccaagaaactcccgagggcagacgtactaacggtttttaccaagggggtaaccaacgaacgttcccgacggtaaacgtacgaacgggaccttaacgaacgtcgggaacccttaggtaacgggtcgggcccgttaggggttataccgttaggaaacgaccgtacgggtacttaagttagttattacgttaggtgtagagtaattacgagggttacgggggaacgtccgtcggttcccgtacgacccgtaaggttcgggggacccgacgggggtaccctcgggtaccgacccggttcctacccg

SEQ ID NO: 353858 - DNA, 532 bp, Homo sapiens
  misc_feature: GZ8MTXP02JASMV.25.75.G09.1.454.CMB.2.raw
  modified_base (219)..(219): a, c, t, g, unknown or other
  misc_feature (219)..(219): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (417)..(417): a, c, t, g, unknown or other
  misc_feature (417)..(417): n is a, c, g, or t
tcagactgtacagtcacgaccggtgctcgatttagtatagacatcaggggacccaacaaccacatccctcctcagaagccaccagagcacaactcctcaccatggactggacctggaggatcctcttttggtggcagcagccacaggtgcccactcccaggtccagcttgtgcagtctggggctgaggtgaagagcctgggcctcagtgaaggtttccngcaaggcttctggatacaccttcgcaagtcatgctctcattggcncgccacggcccccgganagggcttgagtggatgggatggatcaacnctgaccaatgtaatgacaaactncgaccaagaactccgagggcagactcacgtttanaggacnaactcgngatacgagctacatcgacgtgagtcgccgtaggtacncgtagacgacgacgtctatgtatactgtagtagagtagtacgagggtagggacgtcgtccgtaccgcgtaacgcggttcggggaccgacggggtacccgtcggtacacccggtcc

SEQ ID NO: 353859 - DNA, 556 bp, Homo sapiens
  misc_feature: GZ8MTXP02GA8M8.25.75.G09.1.454.CMB.2.raw
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (413)..(413): a, c, t, g, unknown or other
  misc_feature (413)..(413): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccgacggcccccgganaagggcttgagtggagtgggatggatcaacactgaccaagtggtaatgactaaactactcgacccaagaaactcccgaagggcagacgtcacgtttacgagggacacatccgcgagtacgagctanagtcggactgagtgccttaggtatcgtagaagacacgggactagtgtattactgtgtgagtatacgaggtggggatcgtcgtccgtacgaccgtagttcggggccgtaacgggggtacccctggtacccacccgttcgtcccg

SEQ ID NO: 353860 - DNA, 536 bp, Homo sapiens
  misc_feature: GZ8MTXP02IABQA.25.75.G09.1.454.CMB.2.raw
  modified_base (284)..(284): a, c, t, g, unknown or other
  misc_feature (284)..(284): n is a, c, g, or t
  modified_base (388)..(388): a, c, t, g, unknown or other
  misc_feature (388)..(388): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccgganaagggcttgagtggatgggatggatcaacactgccaatggtaaatgacaaactatgcccagaaactcccgagggcagagtcacgtttacagggacacatcccgngagtacaggctacatcggacctgagtcgcgtaggtactgtagacgacgacggtatagtagtattagtgtgtagacgagtagagggtgggacgtcgtcgtccgaccgtacgtaggtcggaccggaccggtcgtcgccgttaccgctccg

SEQ ID NO: 353861 - DNA, 539 bp, Homo sapiens
  misc_feature: GZ8MTXP02JCCF7.25.75.G09.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
  modified_base (483)..(483): a, c, t, g, unknown or other
  misc_feature (483)..(483): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccgganaagggcttgagtggatgggatggatcaacactgccaatggtaaatgacaaaactatacgaccccaagaaactcccgaaggggacagagtcaacgtttacgtagggacacatcccgngagtacaggctanatggacctgagtgcctggtatcgtagagacacggctatgtattacgtgtgtgagatacgaggtggggacnctcgtcctacgactagttcggggccgacggggaccctgggtcctaccggtctcccg

SEQ ID NO: 353862 - DNA, 515 bp, Homo sapiens
  misc_feature: GZ8MTXP02J1LCE.25.75.G09.1.454.CMB.2.raw
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttgcaagtcatgctcttcattgggtncgccaggccccccgganaagggcttgagtggatgggatggatcaacactgccaaatggtaaatgcaaaactatgccccagaaatcccaggcagagtcacgtttacagggacacatcccgngagtacaggctacatgactgagngcgtgtntngagagacgntatgtatatgtgtgagatacagagggacggcgtcgtccgtccgaccgtacgtcggcggacgggaccgtcggtccgtaccgtcctccg

SEQ ID NO: 353863 - DNA, 589 bp, Homo sapiens
  misc_feature: GZ8MTXP02HVIT9.25.75.G09.1.454.CMB.2.raw
  modified_base (319)..(319): a, c, t, g, unknown or other
  misc_feature (319)..(319): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcagttgggtgcgccgacggcccccggagaagggcttggagtggatgggatggatcaacnctgccaatggtaaatgacaaactatcgaccccaagaaaactcccgaaggggacaggtacgtacctaacgtttacgtaacggggacacgtactcccgacgagtacgaggactaacgagtcggacctggacgtcggccttaggtactcgtaggaagaccgacgggtctagttgttaatttacgtgttgtagagtaatacgaggtggggactcgtcgtccgtacgacgtaggttcggggccgaacggggtccctggtcctaccggttctcccg

SEQ ID NO: 353864 - DNA, 556 bp, Homo sapiens
  misc_feature: GZ8MTXP02IQL8M.25.75.G09.1.454.CMB.2.raw
  modified_base (391)..(391): a, c, t, g, unknown or other
  misc_feature (391)..(391): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctgggctgaggtgaagagcctggggcctcagtgaaggtttcctgcaaggcttctggatacaccttcgcaagtcatgctcttcattgggtgcgcaggcccccggacaagggcttgagtggatgggatggatcaacactgccaatggtaaatgacaaactactcgacccagaaaactccccgagggacaggagtcacgtttactagggacacatccgngagtacaggctagatggacctgagtggcctggtatcgtgaagacagggctagtgttattactgttgtagagtataacgaggttggggacgtcgttcggtcccgtacgaccgtagttcgggggcccgtacgggggtacccctggggtccctaccggtccttacccg

SEQ ID NO: 353865 - DNA, 557 bp, Homo sapiens
  misc_feature: GZ8MTXP02HVPXX.25.75.G09.1.454.CMB.2.raw
  modified_base (344)..(344): a, c, t, g, unknown or other
  misc_feature (344)..(344): n is a, c, g, or t
  modified_base (395)..(395): a, c, t, g, unknown or other
  misc_feature (395)..(395): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcagttgggtgcgcccgacggcccccggacgaagggcttgagtggatgggatggatcaacactgccaagtggtaaatgacaaactntgaccccaagaaactcccgaggggcaggagtctacgtttacgagggacacntcccgagacgtacaggctacagtcggacctgagtggccttggtatcgtagaagacgacggctatgtattacgtgtgtagagtatacgaggtggggactcgttcgtccgtacgacctaggttccggggccgacgggggtaccctcggtccaccggttctcccg

SEQ ID NO: 353866 - DNA, 564 bp, Homo sapiens
  misc_feature: GZ8MTXP02G4BG0.25.75.G09.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccgganagggcttgagtggatgggatggatcaacactgaccaagtggtaaatgactaaactactcgaccccaagaaactcccgaagggcagacgtctaacgtttacgagggacacgactccgacgagtacaggactacgagtcggacctggacgtcggcctaggtatcgtagaagactacgggactagtgttaattactggtagtagagtatacgaggtggggactcgtcgtccgtcgaccgtagttcggggaccgtacggggtaccctggtaccaccgtctcccg

SEQ ID NO: 353867 - DNA, 679 bp, Homo sapiens
  misc_feature: GZ8MTXP02GVDB1.25.75.G09.1.454.CMB.2.raw
  modified_base (270)..(270): a, c, t, g, unknown or other
  misc_feature (270)..(270): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcagtgaaggtttcctgcaaggcttcgtggatacaccttcgcaagtcatgctcttcattgggtncgccacggcccccgagaggcttgagtggagtgggatggatcaacactgaccaagtggtaatgactaaactatcgacccaagaaaactccccgaaggggacaggtacgtctaaacggttttacgaggggaaccacgtaactcccggacgtaaacgtaccgaacgggaccttaaaccgaacggttaccgggaacccttagggaaacgggttcggggtaccccgtttaggggtaaacttccggttaagggtaaacggaccgtaaccggggtaccttaagttacggttaatttacgtaggttggttagagtaagtacggagggttaggggacgtcgttaccgtcccgtacgtaccgtaggttccgggggaccgaacgggggtacccctcgggtacctacccggtacttccccg

SEQ ID NO: 353868 - DNA, 514 bp, Homo sapiens
  misc_feature: GZ8MTXP02HOS3F.25.75.G09.1.454.CMB.2.raw
  modified_base (282)..(282): a, c, t, g, unknown or other
  misc_feature (282)..(282): n is a, c, g, or t
  modified_base (356)..(356): a, c, t, g, unknown or other
  misc_feature (356)..(356): n is a, c, g, or t
  modified_base (464)..(464): a, c, t, g, unknown or other
  misc_feature (464)..(464): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggctcagtgaaggtttcctgcaaggcttctggatacaccttgcaagtcatgctcttcattgggtgcgccaggcccccgganaagggcttgagtggatgggatggatcaacactgccaatggtaaatgcaaactatgacccagaaactccgaggcngagtcacgtttactagggacacatccgcgagtacaggctacatgacctgagtgcctggtatctagaagcacggctagtgtatactgtgtgacgatacgaggtggggancgtcgtccgtcgaccagttcggggccaggggccctggtcaccgtctcccg

SEQ ID NO: 353869 - DNA, 606 bp, Homo sapiens
  misc_feature: GZ8MTXP02JHWCD.25.75.G09.1.454.CMB.2.raw
  modified_base (285)..(285): a, c, t, g, unknown or other
  misc_feature (285)..(285): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccacggcccccgganaacgggcttgagtggagtgggatggatcaacactgccaatggtaaatgacaaactatacgaccccaagaaaactccccgagggacaggagttaccaacgttttaacgaggggaaccacgactacccgacgacgtacgaggcctaacgatcggacccttggacgtggcccgttagggtactcgtaggaaagaccgacgggtctaagttggtattacgtgtaggtagaagtatacgagggttggggacgtcgtacggtcctacggtaccgtacggttcggggaccgtacgggggacccgtgggtaccctaccggtcctacccg

SEQ ID NO: 353870 - DNA, 559 bp, Homo sapiens
  misc_feature: GZ8MTXP02GR7T5.25.75.G09.1.454.CMB.2.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (262)..(262): a, c, t, g, unknown or other
  misc_feature (262)..(262): n is a, c, g, or t
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgagtttccngcaggcttngatcacttcgcaagtcatgctcttcattgggtncgccacggccccccgganaagggcttggagtggatgggatggatcaacnctgccaagtggtaaatgacaaactactcgaccctaagaaactccccgaagggcaggtacgtacacggtttacaggggacacagtccgacgaagtacaggctacagtcggacctgagtcgcctggtactcgtagaagacgacggctagtgttatacgtgtgtgagtatacgaggttagggacgtcgtcgtccgtacgaccgtaggttcgggggaccgtacgggggaccctgggtcctaccggtctcccg

SEQ ID NO: 353871 - DNA, 606 bp, Homo sapiens
  misc_feature: GZ8MTXP02HLIGT.25.75.G09.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccgganaagggcttgagtggagtgggatggatacaacactgaccaatggtaatgacaaactatcgacccagaaaactcccaggggcaggagtctaacgtttacgagggacactatcccgagaagtacaggctaacagtcggacctggagtgccgttaggtactctaggaaacgaccgacgggaccttagtaggttacttaacgtggttgtacgagtaattacggagggttgggggaacgttccgttcggttaccctacggaccctagggttcgggggtccccggaaagggggttcccccttggggtccctacccgggtttcctccccg

SEQ ID NO: 353872 - DNA, 571 bp, Homo sapiens
  misc_feature: GZ8MTXP02GX2Y5.25.75.G09.1.454.CMB.2.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (400)..(400): a, c, t, g, unknown or other
  misc_feature (400)..(400): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccgganaagggcttgagtggagtgggatggatcaacgactgccaatggtaatgacaaatactcgacccagaaactcccgaaggggcaggacgtcaacgttttacgagggacacatacccgngaagtacaggactacgatcggacctggacgtggccttagggtatcgtgaagacacgggctagtgtattacgtgtgtagagagttacgagggtgggacgtcgttacgtccgtcgtaaccgtaggttcggggaccgtacgggggtacccgtcggtaccgtaccggtctacccg

SEQ ID NO: 353873 - DNA, 529 bp, Homo sapiens
  misc_feature: GZ8MTXP02JH69X.25.75.G09.1.454.CMB.2.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (273)..(273): a, c, t, g, unknown or other
  misc_feature (273)..(273): n is a, c, g, or t
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctgggcctnagtgagttcngcagcttngatacacttgcaagtcatgctcttcattgggtgcgccaggcccccgganaagggcttgagtggatgggatggatcaacactgccaatggtaaatgacaaactatcgacccaagaaatccccgagggcagagtcacgtttacagggacacatccgngagtacaggctacatggacctgagtgctggtatntgaagacacggtctagtcgtaattacgtgttgtagagatacgagggtggggacgtctcgtccgtacgaccgtagtcgggggaccacgggggtaccctgggtccaccggtctacccg

SEQ ID NO: 353874 - DNA, 624 bp, Homo sapiens
  misc_feature: GZ8MTXP02J1G1X.25.75.G09.1.454.CMB.2.raw
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccaatcccaggtccagcttgtgcagtctggggctgaggtgaagaagccgtggggcctcagtgtaaggtttcctgcaaggcttcgtggatacaccttcgcaagtcatgcttcttcagttgggtgccgccgacggcccccggagaacgggcttgaggtggagtgggatggatacaacgactgacctaagtggtaaatcgactaaaactcgtacgacccaagaaacctcccgaagggacagagtaccgtaacgtttacgacgggacacgacgtccgacgaagtacgaggctacagtcggacctggacgtaggccgttaggtactcgtaggaacgaccgacgggtactagttagttaacttacgtggttagtaggtaagtaacgtacgtaggggtagggacgtcgttaccgtccgtaccgaaccggtaggttccggggaccggtacggggtaccccttcggcccgtaccgtcgtcccg

SEQ ID NO: 353875 - DNA, 597 bp, Homo sapiens
  misc_feature: GZ8MTXP02IHRYQ.25.75.G09.1.454.CMB.2.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (314)..(314): a, c, t, g, unknown or other
  misc_feature (314)..(314): n is a, c, g, or t
  modified_base (339)..(339): a, c, t, g, unknown or other
  misc_feature (339)..(339): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccgganagggcttgagtggatgggatggatcaacnctgcctaatggtaaatgacaaactntacgcccaagaaactcccgagggacaggacgtcaacggttttacgagggaacacgactccgacgagtacaggctaacgagtacggacctgacgttcggccttgggtaactcgtaggaacgacacgggacttagtggttatttacgtgttgtagtaagtacttaacgagggtggggacgtcgtaccggtccgtaccgtacccgtaggttccggggaccgtacgggggacccccttggtacccgtacccggtcctacccg

SEQ ID NO: 353876 - DNA, 593 bp, Homo sapiens
  misc_feature: GZ8MTXP02F2BZF.25.75.G09.1.454.CMB.2.raw
  modified_base (173)..(173): a, c, t, g, unknown or other
  misc_feature (173)..(173): n is a, c, g, or t
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgngcagtctggggctggaggtgaagagccgtggggcctnagtgaaggtttccngcaaggcttcnggatacaccttcgcaagtcatgctcttcattgggncgccacggcccccgganaggcttgagtggatggatggatcaacnctgacctaatggtaatgactaaactactcgacccaagaaactcccgaaggggacaggtacgtacgtaacggtttacgaggggacacgtacgtcccgacgaaggtaccgagggcctaagacgttacggacctgacggtcgcgttagggtactcgtagaacgactaccgggnttaagngttaattacgtgtgtagagtatacgagggtgggtactccgtacgtaccgtcgaccgtagttcggggaccgtaacgggcccttaggccctaccggtcctacccg

SEQ ID NO: 353877 - DNA, 597 bp, Homo sapiens
  misc_feature: GZ8MTXP02GS6UK.25.75.G09.1.454.CMB.2.raw
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (404)..(404): a, c, t, g, unknown or other
  misc_feature (404)..(404): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggtncgccacggcccccgganagggcttgagtggagtgggatggatcaacactgccaagtggtaatgacaaactatcgacccaagaaactcccgaggggacagacgtactaacgtttacgacggggacacgacgtacccgngagtacaggctacgagtcggacctgagtcggccttggtactcgtaggaacgacgacggtactagtgttaatttacgtgttgtaggaagtagtaacgtagggtaggggacgtcgtccggtcctaccggtaccgtaggttcgggggcccgtaacgggggtaccccgttgggtacccgtacccggttcgttccccg

SEQ ID NO: 353878 - DNA, 552 bp, Homo sapiens
  misc_feature: GZ8MTXP02IL5US.25.75.G09.1.454.CMB.2.raw
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctnagtgaaggtttcctgcaaggcttctggatacaccttcgcaagtcatgctcttcattgggtgcgccaggcccccgganaagggcttgagtggatgggatggatcaacactgccaatggtaaatgacaaactatgacccaagaaaactcccgaagggccaggagtactaacggtttaactacggggacaacgatcccgcgagtacaggctacatggactgagtgctggtatcgtagaagacacggactagttgtattacgtgtgttgagattacgaggtggggacgtcgtcgtcccttacggacctaggttcggggccacgggggaccctggtccaccggtctcccg

SEQ ID NO: 353879 - DNA, 588 bp, Homo sapiens
  misc_feature: GZ8MTXP02JR6B8.25.75.G09.1.454.CMB.2.raw
  modified_base (272)..(272): a, c, t, g, unknown or other
  misc_feature (272)..(272): n is a, c, g, or t
  modified_base (319)..(319): a, c, t, g, unknown or other
  misc_feature (319)..(319): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggcttcgtggatacaccttcgcaagtcatgctcttcagttgggtnccgccacggcccccggagagggcttgagtggatgggatggatcaacnctgaccaaagttggtaaatgaacaaactatcgacccagaaactccgagggcagagtctacgtttacagggacacactccgagacgtacgtaggactacgagtcggacctggacgtacgccgttagggtacttcgtaggaacgacgtacgggtactagttagttaatacgttgtaggtagtagtagtacgagggtggggactcgttacgtccgtacgaccgtaggtcggggaccgacggggtacccgtacggtccacccggttcctcccg

SEQ ID NO: 353880 - DNA, 536 bp, Homo sapiens
  misc_feature: GZ8MTXP02JLZMY.25.75.G09.1.454.CMB.2.raw
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
  modified_base (450)..(450): a, c, t, g, unknown or other
  misc_feature (450)..(450): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccacggcccccgganaagggcttgagtggatgggatggatcaacnctgccaatggtaaatgacaaactactgacccaagaaactcccgagggcagacgtcacgtttacgagggacacactccgcgaagtacgaggctacagtcggacctgagtggcctgggtatcgtagaagacacgggntagtgtattacgtgtgtagagatacgaggtgggactcgtcgtccgtcgacagttggggccaaggggccctgggtccaccgtctccg

SEQ ID NO: 353881 - DNA, 636 bp, Homo sapiens
  misc_feature: GZ8MTXP02HI763.25.75.G09.1.454.CMB.2.raw
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcagtgaaggtttcctgcaaggcttcgtggatacaccttcgcaagtcatgctcttcagttgggtcgcgccgacggcccccggagaagggcttgagtggagtgggatggatcaacactgaccaagtggtaaatgacaaatactcgacccaagaaactcccgaaggggcaggacgttacgtaaccggttttaacgaacggggtaaccaacgtacgtcccgacgtaacgtacgacgggtaccttaacgacgttcggaacccgttgggaacggtcgggtaccgttacggtacgttaccgttaggaaacgtaccgacgggtacttagttacgttattacgttgtagttagagtaagtacgaggtggggactcgttcgtccgtacgtaccgtaggtcggggccgacggggtacctcggtccgaccggttcgtcccg

SEQ ID NO: 353882 - DNA, 582 bp, Homo sapiens
  misc_feature: GZ8MTXP02GVPYQ.25.75.G09.1.454.CMB.2.raw
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
  modified_base (312)..(312): a, c, t, g, unknown or other
  misc_feature (312)..(312): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctgggcctnagtgagtttcctgcaggcttntgatacaccttcgcaagtcatgctcttcattgggtgcgccgacggccccccggagaagggcttgagtggatgggatggatcaacnctgaccaatggtaaatgacaaactctcgacccagaaactcccgaggcaggacgtcgtaacgtttacgagggactacgacgtccgacgacgtacgaggactacagtcggacctggagtcggccgtagggtactcgtagagacgacggtctagtgtattacgtggtgtagagtataacgagggtggggacgtcgtcgttcccgtacgtacccgtaggttccgggggaccgtaccgggggtacccgttcggtaccgtacccggttccgtcccg

SEQ ID NO: 353883 - DNA, 610 bp, Homo sapiens
  misc_feature: GZ8MTXP02I4YC1.25.75.G09.1.454.CMB.2.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (262)..(262): a, c, t, g, unknown or other
  misc_feature (262)..(262): n is a, c, g, or t
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
  modified_base (437)..(437): a, c, t, g, unknown or other
  misc_feature (437)..(437): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctgggctgaggtgaagaagctgggctnagtgagtttccngcaaggcttctggatacaccttcgcaagtcatgctcttcattgggtncgccgacggcccccggagagggcttgagtggagtgggatggatcaacnctgacctaagttggtaaancgaactaaactatcgacccaaagaaactccccgaagggactaggacgttaccgtaacggttttaacgaggggtaccaacgacgttcccgacgtagtacgaggcctaanacgtcggacctggagtcgcgttaggtactcgtaggaagacctacgggtactaagttgttaatttacgtggttgtagagtaatacggagggtacggggactccgttcgtcccgtacgaccgtaaggttcggggacccgtacgggggtaccctggtaccctaccggttcttcccg

SEQ ID NO: 353884 - DNA, 552 bp, Homo sapiens
  misc_feature: GZ8MTXP02F9LAX.25.75.G09.1.454.CMB.2.raw
  modified_base (286)..(286): a, c, t, g, unknown or other
  misc_feature (286)..(286): n is a, c, g, or t
  modified_base (394)..(394): a, c, t, g, unknown or other
  misc_feature (394)..(394): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccacggcccccgganaagggcttgagtggatgggatggatcaacactgccaagtggtaaatgacaaactatcgacccaagaaactcccgagggcagagtctacgtttacagggacacatccgngacgtacaggctacatcggacctgagtcgcctggtatcgtagaagacacggctagtgttattactgtgtgacgatacgaggtcggggatccgtacggtcctcgaccgtaggttcgggggaccgacgggggtaccctggtaccgacccgttcgtccccg

SEQ ID NO: 353885 - DNA, 573 bp, Homo sapiens
  misc_feature: GZ8MTXP02JT0ZJ.25.75.G09.1.454.CMB.2.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
  modified_base (416)..(416): a, c, t, g, unknown or other
  misc_feature (416)..(416): n is a, c, g, or t
  modified_base (441)..(441): a, c, t, g, unknown or other
  misc_feature (441)..(441): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggtncgccaggcccccganaagggcttgagtggatgggatggatcaacnctgacctaagtggtaatgactaaactacgtcgaccaagaaactcccgagggcagacgtactacgtttacgagggacacacgtccgacgaagtacgaggctaanagtcggacctgagtcgccgtaggtntcgtagaacgacgacgggtactagtagttattacgtgtgtagagtatacgagggttagggacgtccgtcgtccacggaccgtaggttccggggccggtacggggtacccgtggtaccctaccggtcctcccg

SEQ ID NO: 353886 - DNA, 539 bp, Homo sapiens
  misc_feature: GZ8MTXP02J24JD.25.75.G09.1.454.CMB.2.raw
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (482)..(482): a, c, t, g, unknown or other
  misc_feature (482)..(482): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgccccactccccaggtccagcttgtgcagtctggggctgaggtgagaagcctggggcctcagtgaaggtttcctgcaaggcttctggatcaccttgcaagtcatgctcttcattgggtgcgcccaggccccccgganaagggcttgagtggatggggatggatcaaacnctgccaatggtaatgcaaactactgccccagaaaactccccgaggggcngagtcacggttttactaggggacacatccgngagtacaggctacatggacctggagtggcctggtatcgtgaagacacgggctatgtattactggtntganatacagtgggggancgtcgtccctcgaccagttcggggccacgggggacccctggtccgaccgtcttcccg

SEQ ID NO: 353887 - DNA, 552 bp, Homo sapiens
  misc_feature: GZ8MTXP02HJVBL.25.75.G09.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (438)..(438): a, c, t, g, unknown or other
  misc_feature (438)..(438): n is a, c, g, or t
  modified_base (458)..(458): a, c, t, g, unknown or other
  misc_feature (458)..(458): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccgganaggcttgagtggatgggatggatcaacnctgccaatggtaaatgacaaactatcgaccctagaaactcccgagggcagacgtacacgtttacgaggacacgactcgcgagtacaggctacatcggactgagtcgctggatcagtaagacacggntatgtattacgtgtgagtanagtacgaggtggggacgtcgttcgtccgtacgaccgtaggttcgggggacccgtaacgggggtaccctgggtacccgaccggttccttaccccg

SEQ ID NO: 353888 - DNA, 584 bp, Homo sapiens
  misc_feature: GZ8MTXP02JTKMG.25.75.G09.1.454.CMB.2.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccgganagggcttgagtggatgggatggatcaacactgaccaatgggtaaatgacaaaactactacgacccagaaaactccccgaaggggcaggacgtactacgtttacgtaaggggacacagtcccgacgagtacaggactacgatcggacctggacgtgccgtaggtatcgtagaagacacgggtactagtgttacttactggtagtagagtattacgaggttggggacgtccgtacgtccgtacgtaccgaggttaacgggggcccgaagggggtacccctggtaccgtaccgtccgtcccg

SEQ ID NO: 353889 - DNA, 595 bp, Homo sapiens
  misc_feature: GZ8MTXP02IHLX2.25.75.G09.1.454.CMB.2.raw
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagacacaggtgcccactcccaggtccagcttgtgcagtctggggctgaggtgaagagcctggggcctcagtgaaggtttcctgcaaggcttctggatacaccttcgcaagtcatgctcttcattgggtncgccacggcccccgganagggcttggagtggatgggatggatcaacnctgaccaagtggtaaactgaactaactcgtcgacccaagaaacctccgaggcaggtacgtacctaacggttttacgaggggaaccacgtacgtcccgagtacgtacgacggactaacgagtcggacctggaggtcgccgttaggtactcgtaggaacgacgacgggtacttagttagttacttacgtgttggtagacgtagtacggagggtgggacgtcgtacgtccgtacgacgtaggtcggggaccgtaacggggtccctggtacctaccggtcctccg

SEQ ID NO: 353890 - DNA, 616 bp, Homo sapiens
  misc_feature: GZ8MTXP02GUOBV.25.75.G09.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (526)..(526): a, c, t, g, unknown or other
  misc_feature (526)..(526): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccacggcccccgganaagggcttggagtggagtgggatggatcaacactgaccaagttggtaaatgactaaactactcgacccagaaactcccgagggcaggacgtactaacgtttacgacggggtacaacgtacgtacccgacgaacgtacgacggactaacgagttcggaccctggaaggtcggaccgttagggtactccgtaggaacgactacgggacttagtagttacttacgtgttgtagagtataacggnggttaggggacgtccgttacgtccctcggaaccgtagttcgggggacccgtaacgggggtacccctacgggtcctacccggttcctcccg

SEQ ID NO: 353891 - DNA, 717 bp, Homo sapiens
  misc_feature: GZ8MTXP02HK99D.25.75.G09.1.454.CMB.2.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccgganaaggcttgagtggatgggatggatcaacacgtgaccaatggtaaatgactaaaactatcgacccaagtaaactcccgaaggggacaggtacgttacgtaaacgttttacgaaggggaacacgtaactcccgagaacgttaacgacgggacttaaccaagttcggggaaaccttggtaaacgggtcgggtacccgttaggggttaacttccgtagggtaaaacgtaccgaaccggggtacctttaaagttcgggtttaaactttcgttagggttggttaggaaacgtaacgtttaacgggaaaggggttcgggggttaaagcccgtttaccgggtccccgttaccggtaacccgtacggggtttaaccgggggaccccgtaacggggggtacccccttgggtttaccccgaacccgggtttcccttaccccgg

SEQ ID NO: 353892 - DNA, 573 bp, Homo sapiens
  misc_feature: GZ8MTXP02GU0AQ.25.75.G09.1.454.CMB.2.raw
  modified_base (270)..(270): a, c, t, g, unknown or other
  misc_feature (270)..(270): n is a, c, g, or t
  modified_base (319)..(319): a, c, t, g, unknown or other
  misc_feature (319)..(319): n is a, c, g, or t
  modified_base (408)..(408): a, c, t, g, unknown or other
  misc_feature (408)..(408): n is a, c, g, or t
  modified_base (490)..(490): a, c, t, g, unknown or other
  misc_feature (490)..(490): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcagttgggtncgccgacggccccccggagaagggcttgagtggatgggatggatcaacnctgacctaagtggtaaatgacaaactactcgacccaagaaaactcccgaagggccagacgtctaacgtttacgagggacacgatcccgngagtacaggactacgatcggacctggagtggccttggtatcgtagaagacgacgggtactagtgttacttacgtgtgtaganagtacgaggtgggacgtcccgtcgtacgaccgtaggttcggggaaccgtacggggaccctggtacccaccggtcctcctaccg

SEQ ID NO: 353893 - DNA, 576 bp, Homo sapiens
  misc_feature: GZ8MTXP02G4XKR.25.75.G09.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (526)..(526): a, c, t, g, unknown or other
  misc_feature (526)..(526): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccgganagggctgagtggatgggatggatcaacnctgccaatggtaatgacaaactatcgacccagaaactcccgaaggggcaggagtacctaacggtttaccgtaggggaccacacgtcccgacgacgtaccagggactacgaatcggggaccctgggaacggtcgggacccgttagggtaacttcgtaggaagaaccgtacgggtctaagtgttattacgtggtagtgacgatacgagggtggganctcgtcctcgacagttcggggcacgggggacctggtccaccggtctcccg

SEQ ID NO: 353894 - DNA, 532 bp, Homo sapiens
  misc_feature: GZ8MTXP02GNKAS.25.75.G09.1.454.CMB.2.raw
  modified_base (269)..(269): a, c, t, g, unknown or other
  misc_feature (269)..(269): n is a, c, g, or t
  modified_base (314)..(314): a, c, t, g, unknown or other
  misc_feature (314)..(314): n is a, c, g, or t
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccctggacagggcttgagtggatgggatggatcaacnctgccaagtggtaatgacaaactatcgacccaagaactcccgaggggccagacgtacctacgtttacgacgggacacacgtccgacgagtacgaggctacgagtggacctgacgtggccgtggtatcgtagaagacgagctatgtagttacngtgtagagtatacgaggtgggancgtcgctcgacgtaagtcgggcgacgggccctggtccacgtcc

SEQ ID NO: 353895 - DNA, 575 bp, Homo sapiens
  misc_feature: GZ8MTXP02HFLFK.25.75.G09.1.454.CMB.2.raw
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccacggcccccgganaagggcttgagtggatgggatggatcaacnctgccaatggtaaatgactaaaactcgtcgacccaagaaaactcccgaaggggcagacgtactaacgtttacgaggggacacactccgacgacgtacgaggctacagtcggacctgagtcggccttagggtatcgtaggaagacgtacggtacttagtgttaattacgtgttgtagaagagttaacgaggtggggactcgtcgtcccgtacgaccgtaggttcggggcgacgggggtacctcggtaccaccgtctcccg

SEQ ID NO: 353896 - DNA, 642 bp, Homo sapiens
  misc_feature: GZ8MTXP02IE2Z9.25.75.G09.1.454.CMB.2.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctnagtgaaggtttccngcaaggcttnggatacaccttgcaagtcatgctcttcagttgggtnccgccacggcccccganagggcttgagtggatgggatggatcaacgctgacctaagtggtaaatcgacaaactacgtcgaccccaagaaactcccgaagggccagtacgtacgtaaccgtttaccgaaggggacaactacgtaccgacgaagtacgacggactaacgagtcggaacctggacggtcggaccgttaggttactccgtaggaaacgacgtaacgggtacttaagttagttaacttacgttggttagtaggtaagtaattacggtaagggttcggggaacgttcggttccgttaccgtaccgtaaccgtagggttaaccgggggaccgtacgggggtaccctacgggttcccaccggtttccctccg

SEQ ID NO: 353897 - DNA, 584 bp, Homo sapiens
  misc_feature: GZ8MTXP02I4K0Y.25.75.G09.1.454.CMB.2.raw
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagagccgtggggcctcagtgaaggtttcctgcaaggcttctggatacaccttcgcaagtcatgctcttnattgggtgcgccacggcccccgganaagggcttggagtggagtggatggatcaacncgtgccaagtggtaaatgactaaaactctcgacccaagaaactcccgagggcagacgtctacggtttacagggacacgactccgagacgtacgacgtcaagtagtcggacctggacggtcgcgttaggtactacgtagtacgaccgacggtactagtcgttaattgtggtagtagaagtagtacggtagggtagggactccgtcgttccgtacggactagggttcgggaccggtacgggtacccgtggtaccctaccggttctacccg

SEQ ID NO: 353898 - DNA, 722 bp, Homo sapiens
  misc_feature: GZ8MTXP02JOA06.25.75.G09.1.454.CMB.2.raw
  modified_base (290)..(290): a, c, t, g, unknown or other
  misc_feature (290)..(290): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagccgtggggcctcagtgaaggtttcctgcaaggcttctggatacaccttcgcaagtcatgctcttcagttgggtgcgcccgacggcccccgganacgggcttggagtggagtgggatggatcgaacactgaccaaagttcggtaaatcgaactaaactactacgacccaaagaaactccccgagggcaggtacgtactaacgtttaacgaggggaacctacgacgtacccgacgaacgtaacgacggtactaaccgtagtcgggaacccgtaggtaaggtcggtccgttaggggtacttaccggtaaggaaacgaccgtaacggggtactttaaacgttaggttaacgtttaaccgttggttaggtaggtaaacggttaacgtaacgggtaggggttaaagggggcgttaccggttaccggttccccgtaacccgggtacccgttaacggggttccgggggaccccggtaaccggggggtaccccgttccggggtaccccgtaacccggttacccgtttcccccgg

SEQ ID NO: 353899 - DNA, 670 bp, Homo sapiens
  misc_feature: GZ8MTXP02IDK4K.25.75.G09.1.454.CMB.2.raw
  modified_base (286)..(286): a, c, t, g, unknown or other
  misc_feature (286)..(286): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctggaggtgaagaagccgtggggcctgagtgaaggtttcctgcaaggcttctggatacacttgcaagtcatgctcttcattgggtgcgccgacggcccccgganaacgggcttgagtggatgggatggatcaacactgaccaaatgggtaaatggacaaaactagtacgacccaagaaactcccgaaggggaccagacgttacctaacgtttttaacgaaacggggactaaacacgtaccgacgaaagtacgaggtactacgagtacggaccttaggaacgtggacccgttaggtaacgtccgttagaaacgaacgtaccgggacttaagttcggttaaacttaacgttggtagttaggaaaagtaccttacggagggttagggggaactcgtacccggtttaccgacccggtaaacctgggtttccgggggtacccgaaccgggggtaccccttcggggtacccgtacccgggtttacccccgtccg

SEQ ID NO: 353900 - DNA, 711 bp, Homo sapiens
  misc_feature: GZ8MTXP02JAJBR.25.75.G09.1.454.CMB.2.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctnagtgaaggtttccngcaaggcttcnggatacaccttcgcaagtcatgctcttcattgggtncgccacggcccccganaagggcttgagtggagtgggatggactacaacacgtcgaaccgtaagttaggtaaatcggaaacctaaacgttacgtaccgaaccccgaaaagtaaaaccgtccccggaaggggcctaaggggtacgttaacccggttacgggttttaaaaccggaacggggtaacccaaccgtaccggttaccccggacgtaacggttaaaccgacgggttacctaacgtaaacggttccgggaaccgttagggtaacggttccgggtaccgtttagggttaacttacggtaacggtaacgaccggtacgggtacttagttagttaacgttgttagtggtagtaacgtattacggagggttggggactccgttaccgtccgtaccgacgtcggttcgggaccgtaacgggtcccgtacggtccaccgttcctccg

SEQ ID NO: 353901 - DNA, 585 bp, Homo sapiens
  misc_feature: GZ8MTXP02JPKWY.25.75.G09.1.454.CMB.2.raw
  modified_base (316)..(316): a, c, t, g, unknown or other
  misc_feature (316)..(316): n is a, c, g, or t
  modified_base (438)..(438): a, c, t, g, unknown or other
  misc_feature (438)..(438): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccacggcccccggagaagggcttgagtggatgggatggatcaacnctgccaatggtaatgacaaactatcgccaagaaactcccgagggcaggacgtactaacgttttacgaggggacacagtccgcgagtacaggctacgatcggacctgagtcgccgttagggtntacgtagaacgacgacggactagttgtattacgtagttgtagtagagtacgtagggtaggggacgtccgttaccgtccgtaccgtacccgtaagggttcggggaccggtacgggggtaccctaggggtcccaaccggttccttcccg

SEQ ID NO: 353902 - DNA, 582 bp, Homo sapiens
  misc_feature: GZ8MTXP02GAIG6.25.75.G09.1.454.CMB.2.raw
  modified_base (453)..(453): a, c, t, g, unknown or other
  misc_feature (453)..(453): n is a, c, g, or t
  modified_base (505)..(505): a, c, t, g, unknown or other
  misc_feature (505)..(505): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttgcaagtcatgctcttcattgggtgcgccacggcccccggagaagggcttgagtggagtggggatggatcgaacactgaccaagtggtaatgacaaactatcgcccaagaaactcccgagggcagacgtactacgtttacgtagggactacacgtccgcgagtacaggctacatcgacctgagtgcctggtatcgtagaagacgacggtntagtgttaacttacgtggttagtggacgtagttaacgagggttcgggggacnccgttccgtaccctcggaacccttagggttcggggccgacgggggtaccccttgggtacccacccggttctaccccg

SEQ ID NO: 353903 - DNA, 597 bp, Homo sapiens
  misc_feature: GZ8MTXP02HECDX.25.75.G09.1.454.CMB.2.raw
  modified_base (232)..(232): a, c, t, g, unknown or other
  misc_feature (232)..(232): n is a, c, g, or t
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttcnggatacaccttcgcaagtcatgctcttcattgggtncgccacggcccccganaacgggcttgagtggagtgggatggatcgaacacgtgccaagtggtaaatgacaaactactgacccaagaaactcccgagggacagacgttacacgtttacgagggacacactccgagacgtacaggctagagtcgactgacgtggcctagggtactcgtagaacgaccgtaggactagtaggtattacgtggttgtaggtaagacgttaacgagggttcggggacgtaccgtcggttaccgtaccgaacgtacggttaacgggggaccgtaacgggggtaccccttagggtcccgtaacccgttctccccgg

SEQ ID NO: 353904 - DNA, 667 bp, Homo sapiens
  misc_feature: GZ8MTXP02I3MI9.25.75.G09.1.454.CMB.2.raw
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggtgcgccacgggccccccggacaagggccttgagtggatgggatggatcaacactgaccaagttggtaaatgactaaactactcgacccaagaaactccccgaaggggccaggacgtacgtaccgtttacgtacggggaacacgactcccgacgtacgtacgaggctacagttcggaaccgttgacggtcggaccgttagggtaacttcgtacggaaacgtaccgaccgggtactagttggtacgtttaacgtggtgttaggaagtacgttaaccggtaggggttacgggggtactccggttaccgttaccccgtaccggtaacccgttaacgggtttcggggggaccccgtacggggggtaaccccttcgggggtaccctaccgggttccctttaccccgg

SEQ ID NO: 353905 - DNA, 583 bp, Homo sapiens
  misc_feature: GZ8MTXP02JJLWO.25.75.G09.1.454.CMB.2.raw
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttcnggatacaccttcgcaagtcatgctcttcattgggtgcgccacggcccccgganaagggcttgagtggagtgggatggatcaacactcgaccaagtggtaatgactaaaactctacgacccaagaaaactccccgaaggggcaggtacgtcgtaaacggttttaaccgaaggggaacctacgaacgtcccgacgaagtaaccgaggcttaaccgatcggaaccttggagtcggccttagggtactcgtagaaacgcgacgggtctatgtattactgtgtagagatacgaggtgggacgtctcgtacctcgaactagtcggggcgtaacggggcctggtaccacgtctcccg

SEQ ID NO: 353906 - DNA, 673 bp, Homo sapiens
  misc_feature: GZ8MTXP02JY44Y.25.75.G09.1.454.CMB.2.raw
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttgcaagtcatgctcttcagttgggtgcgccacggcccccgganagggcttgngtggatgggatggatcaacnctgaccaagtcggtaaatcgacaaaactgtacgccccaagaaaactcccgaggggcagtacgtactaaaccggttttaacgaagggggacaacgacgtacccggacgaacgttacccgagggccctaacgagttacgggacccgttaggaacggtcgggtcccgttaggggttactaccgtaggaacgaccgtacgggtacttaagttccgttaagtttacgtggttggtagtaaggacttaacggaagggttgggggaaacgtccggtaccgttacccgtccggaaaccgtacgggtttcgggggacccggtacgggggtaccccttagggtacccgtacccggtctttacccccgg

SEQ ID NO: 353907 - DNA, 586 bp, Homo sapiens
  misc_feature: GZ8MTXP02HGS5S.25.75.G09.1.454.CMB.2.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (340)..(340): a, c, t, g, unknown or other
  misc_feature (340)..(340): n is a, c, g, or t
  modified_base (514)..(514): a, c, t, g, unknown or other
  misc_feature (514)..(514): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggtncgccaggccccgganagggctgagtggagtgggatggatcaacactgaccaatggtaaatgactaaactacncgacccaagaaactcccgagggcagacgtactacgttacgtagggacacgactccgacgagtacgaggctaacagtacggaccgtggtacgtcggtccgtagggtactacgtaggaacgacgacgggtctagtagttacttagtgtgtagtagtagttacgagggtggggtacncgtccgtaccgtacgaccgtacggttcgggggcgaacgggggtcccgtacgggtccctaccggtctaccccg

SEQ ID NO: 353908 - DNA, 675 bp, Homo sapiens
  misc_feature: GZ8MTXP02JMMHB.25.75.G09.1.454.CMB.2.raw
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (343)..(343): a, c, t, g, unknown or other
  misc_feature (343)..(343): n is a, c, g, or t
  modified_base (404)..(404): a, c, t, g, unknown or other
  misc_feature (404)..(404): n is a, c, g, or t
tcagactgtacagtcacgaccggtgctcgatttagtatagacatcaggggacccaacaaccacatcccccctcagaagcccccagagcacaactcctcaccatggactggacctggaggatcctctttttggtggcagcagccacaggtgcccactcccaggtccagcttgtgcagtctgggctgaggtgaagaagccgtggggcctgagtgaaggtttccngcaaggcttctggactacaccttcgacaagtcatgctcttcagttggncgccacggccccgganaggctgagtggagtgggatggatcaacncgtcgaccaagtggtaatgactaaaactnaccgacccaagtaaactcccgaagggcaagacgtctaacggtttaacgaacgggactaacngtacccggacgtacgtaacgacggtactaacgtaagtcggtaacccgtggaacggttcggtacccgtagggttaactcgtaaggaaacggacgtaacgggtacttaagttagttaattaacgttggtaggtaggtaagtaacgtaagggtaacggggtaggggacgtccgtacccggttccgtacccggtaaaccggttcgggtcgggggtaaccggtaccgggggtacccgttcggggtaacccttccccggtccgttacccgtacccgg

SEQ ID NO: 353909 - DNA, 541 bp, Homo sapiens
  misc_feature: GZ8MTXP02HJNB4.25.75.G09.1.454.CMB.2.raw
  modified_base (283)..(283): a, c, t, g, unknown or other
  misc_feature (283)..(283): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttgcaagtcatgctcttcattgggtgcgccaggcccccganaaggctgagtggatgggatggatcaacactgaccaatggtaaatgacaaaactactcgaccccaagaaaactcccgagggcagagtcacgtttacgagggacacatccgagagtacaggctacatggacctgagtggcctggtatcgtagaagacaggactagtgtattactgtgtgagactagaggtgggagcgtcgtccgtacgacctaggttcggggaccaacgggggtcccctgggtcctacccggttctcccg

SEQ ID NO: 353910 - DNA, 556 bp, Homo sapiens
  misc_feature: GZ8MTXP02JE0B9.25.75.G09.1.454.CMB.2.raw
  modified_base (285)..(285): a, c, t, g, unknown or other
  misc_feature (285)..(285): n is a, c, g, or t
  modified_base (341)..(341): a, c, t, g, unknown or other
  misc_feature (341)..(341): n is a, c, g, or t
  modified_base (459)..(459): a, c, t, g, unknown or other
  misc_feature (459)..(459): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccgganaagggcttgagtggatgggatggatcaacactgaccaagtggtaaatgacaaactntcgacccaagaaactcccaaggggcagacgtcaacggtttaccagggactacatcccgcgagtacaggctacgatacggacctggagtcggcctgggtatcgtagaacgtcaacggtntagtgtatacgtgtgtgagtagtacgaggtgggacgtcgtcgtccgtaccgacgtaggtcggggaccgacgggtccgtggtaccgtaccgtcgtccg

SEQ ID NO: 353911 - DNA, 608 bp, Homo sapiens
  misc_feature: GZ8MTXP02I2CCL.25.75.G09.1.454.CMB.2.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (284)..(284): a, c, t, g, unknown or other
  misc_feature (284)..(284): n is a, c, g, or t
  modified_base (520)..(520): a, c, t, g, unknown or other
  misc_feature (520)..(520): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctgggcctnagtgaaggttccngcaaggcttcnggatacaccttcgcaagtcatgctcttcattgggtgcgccgacggcccccgganaagggcttgagtggatgggatggatcaacacgtgccaaatggtaaatgactaaaactactcgaccccaagaaactcccgaagggcaggacgttctaacgtttacgtaggggaacacgactcccgacgacgtacgagggcctaagagtacgggacccttaggacgtcgggccttgggtacttcgtacgaaagacgacgggcttaagtcgttaagttacgtgttgtagagagtaacgnggttggggacgtcgttccgtccgtacgtaccgtaggttcgggggacccgtacgggggtaccctgggtacccgaccggttccttccccg

SEQ ID NO: 353912 - DNA, 708 bp, Homo sapiens
  misc_feature: GZ8MTXP02H47JY.25.75.G09.1.454.CMB.2.raw
  modified_base (219)..(219): a, c, t, g, unknown or other
  misc_feature (219)..(219): n is a, c, g, or t
  modified_base (283)..(283): a, c, t, g, unknown or other
  misc_feature (283)..(283): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtctggggctgaggtgaagagcctgggctcagtgaagtttccngcaaggcttctggatacaccttgcaagtcatgctcttcattgggtgccgccacggcccccgganaagggcttggagtggagtgggatggatcaaacactagacctaaagtggtaaatgactaaaactacgtacgacccctaagaaaacctccccgaaggggacaggaacgttaccgtaaaccggttttacgaacgggggaccaacgtacgtacccgacgtaaggtaccgagggtacctaacgtaacgttaccgggaccgttaggtaacggttcgggacccgttaggggttacttaccgttagggaaacgtacggacgggtacttaagttaggttaactttacgtaggttaggttagaacgtaagttaacggtaggggttagggggacgtccggttaccggttcccgtaccggtaaccgtagggtttccgggggaccggtaaccgggggtaccccgtacggggttacccgtacccggtttacccgtcccg

SEQ ID NO: 353913 - DNA, 733 bp, Homo sapiens
  misc_feature: GZ8MTXP02I3DEK.25.75.G09.1.454.CMB.2.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctnagtgaaggtttccngcaaggtcttctggatacaccttcgcaagtcatgctcttcagttgggtgccgccacggcccccggaagaagggcttgagttggattgggatgggaatcaaacacgtcgaccctaaagttcgggtaaatggtaacctaaaacttacgtaccgaccccgtaaaggtaaaaccgttccccgaacgggggtaccacgggtacggttacccgtaaaccggtttttaaccgaacgggggtaacctaaccgtacgttacccggacgtaacggttaaccgaacgggtaccttaaccgaacgttccgggtaaccgttgggtaaacggtcgggtacccgttagggttacttaccgttaggaaacgtaccgtaaccgggtacttaacgttgttaacgttttacgtggttaggttacgaggtaacgttacgagggttcggggaacgtccgtaccgtccgtaccgtacgtacgttcgggggacccgtacggggtaccccttggtacccgaccgttcgttacccg

SEQ ID NO: 353914 - DNA, 548 bp, Homo sapiens
  misc_feature: GZ8MTXP02GVJQU.25.75.G09.1.454.CMB.2.raw
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (402)..(402): a, c, t, g, unknown or other
  misc_feature (402)..(402): n is a, c, g, or t
  modified_base (491)..(491): a, c, t, g, unknown or other
  misc_feature (491)..(491): n is a, c, g, or t
  modified_base (509)..(509): a, c, t, g, unknown or other
  misc_feature (509)..(509): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccgctcccaggtccagcttgtgcagtctggggctgaggtgaagagccgtggggcctcagtgaaggtttcctgcaaggcttctggatacaccttcgcaagtcatgctcttcattgggncgccacggcccccgganagggctgagtggatgggatggatcaacnctgaccaagtggtaaatgactaaatactcgacccaagaaactcccgaagggcagtacgtacgtacgtttaacgagggacacgacgtccgngacgtacaggctacgatcggacctggacgtcgcctaggtactcgtagaacgaccacgggctagtagttattacgtgtgtagagatacgnggtggggactcgtcgtcncgtacagtcgggcgacggggcctcggtccaccgtctccg

SEQ ID NO: 353915 - DNA, 774 bp, Homo sapiens
  misc_feature: GZ8MTXP02HIDWJ.25.75.G09.1.454.CMB.2.raw
tcagactgtacagtcacgaccggtgctcgatttagtatagacatcaacacacaaagagggaggaactgctcagttaggacccagacggaaccatggaagccccagcgcagcttctcttcctcctgctactctggctcccagatgccactggagaaattgtgatgacgcagtctccagccctcctgtctgtgtctccgtggggaagcgccaccctctcctgcagggccagtcagagcgttggcaggaacttagcctggtaccagcagaaacctggccagccctccagaccctccctcctctagtcggtcgcctttcccgacccgtaccggggtccccctagaccttaccgtccccccgacgtacggtttccccagggttcgggaccgtaggggttcggggtccgttagggggacctagggtacgtttccaacttcctaccaacctactaccgaacgcccgaacggtcccttggacccgtaggtttacctaaggttaaacggtttatttttacgaccgttttaaaggttttaacgtttaacttcggttacctaaccgttaacggttaaattaaaccgtaaccgttccggggtacccctttaccggggttacgggtttaaccgggtttaccggggaaacccggttaaaacgggggaacccgttaaagggggttaaacggtaaaaacggaacccggtaaaaaccggttaccggttgggttacggggtaaccttacggacccgtaacccttaggttccttacggtttacctttaaccgg

SEQ ID NO: 353916 - DNA, 524 bp, Homo sapiens
  misc_feature: GZ8MTXP02FFNDJ.25.75.G09.1.454.CMB.2.raw
  modified_base (220)..(220): a, c, t, g, unknown or other
  misc_feature (220)..(220): n is a, c, g, or t
  modified_base (282)..(282): a, c, t, g, unknown or other
  misc_feature (282)..(282): n is a, c, g, or t
  modified_base (379)..(379): a, c, t, g, unknown or other
  misc_feature (379)..(379): n is a, c, g, or t
  modified_base (470)..(470): a, c, t, g, unknown or other
  misc_feature (470)..(470): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagaagcctggggcctcagtgaaggtttccngcaaggcttctggatacaccttcgcaagtcatgctcttcattgggtgcgccaggcccccganaagggcttgagtggatgggatggatcaacactgccaatggtaatgcaaactatgacccaagaactcccaggcagagtcagtttacaggacacatcgngagtacaggctacatggacctgagtgggcctagggtatcgtgaacgacgaacggctatagtattacgtgtagtgagatacgagtggggacncgtcgtcctacgacgtaggtcgggacgacggggtacctcggaccaccgtctccg

SEQ ID NO: 353917 - DNA, 613 bp, Homo sapiens
  misc_feature: GZ8MTXP02IBTYZ.25.75.G09.1.454.CMB.2.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
  modified_base (397)..(397): a, c, t, g, unknown or other
  misc_feature (397)..(397): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagagccgtgggcctcagtgaagttcngcaagcttngatacacttgnaagtcatgctcttcagttgggtnccgccgacggcccccgagaacgggcttggagtggatgggatggatcaacnctgacctaatggtaaatgactaaactancgacccaagaaactccgaggcagtagttcaacgtttacgaaggtacactacgtacccgngaagtaccgagctacagtcgactgacgtcgcctaggtactcgtagaaacgacgaccggtatagtagttaagttagttaggttgtaggaaacgtaagtacgggtaaggttcgggggaactaccggttcgtacccgtacggtaacccgtaggggttaaccggggaccggaaaccgggggtcccgtacggggtaccctaaacccgtttccggtaccccg

SEQ ID NO: 353918 - DNA, 707 bp, Homo sapiens
  misc_feature: GZ8MTXP02JHPG0.25.75.G09.1.454.CMB.2.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (336)..(336): a, c, t, g, unknown or other
  misc_feature (336)..(336): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccganaggcttgagtggagtgggatggatcaacactgccaatggtaaatgacaaactntacgaccccaagaaaactcccgaaggggccaggacgttacgtaaccggttttaacgaacggggaaccaacgaacgttacccgacgtaacgttaaccgagggaccttaacgaagttcgggaaacccttgggaacggttcgggacccgtttaggggttaactttaccggtaaggtaaacggaaccgtaccggggtaccttaagttagtttaaccgtttaacgttggttaggttaggaagtaaacgttaacggtagggggttagggggaaacgttccggttaccggttccccgtaccggtaccgtaacgggtttcgggggaccccgtaacggggggttacccctcgggtacccgtacccggtttccttccccgg

SEQ ID NO: 353919 - DNA, 641 bp, Homo sapiens
  misc_feature: GZ8MTXP02HYRXN.25.75.G09.1.454.CMB.2.raw
  modified_base (534)..(534): a, c, t, g, unknown or other
  misc_feature (534)..(534): n is a, c, g, or t
  modified_base (636)..(636): a, c, t, g, unknown or other
  misc_feature (636)..(636): n is a, c, g, or t
tcagactgtacagtcacgaccggtgctcgatttagtatagacatcagggacccaacaaccacatccctcctcagaagcccccagagcacaactcctcaccatggactggacctggaggatcctctttttggtggcagcagccacaggtgcccactcccaggtccagcttgtgcagtctgggctgaggtgaagaagccgtggggcctcagtgaaggtttcctgcaaggcttctggatacaccttcgcaagtcatgctcttcagttgggtgcgccacggcccccggagaacgggtcttgaggtggagtgggatggatacgaaacacgtcggacctaaagttggtaaatcgaacaaaactactcgacccaagaaacctccgaagggcaggacgtactaacgtttaccgtaacggggaccaacacgtcccgacggaacgtaccgagggtacctaagacgttcgggaacctggaacgtcggtaccgttagggtacttacgtaaggaacgaccgtacggcttaagtcggttatttaacgnggttgtagagtactacggtaggtcggggactccgttccggtcctacgaccgtaggtccggggacgtaaccgggggtcccgttacggtacccgacccgtttcnccccg

SEQ ID NO: 353920 - DNA, 564 bp, Homo sapiens
  misc_feature: GZ8MTXP02JGYYI.25.75.G09.1.454.CMB.2.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctgggcctnagtgaaggtttccngcaaggcttctggatacaccttgcaagtcatgctcttcattgggtncgccacggcccccganagggctgagtggatgggatggatcaacactgccaagtggtatgacaaactntcgaccagaactccgaggcngagtcacgtttacgaggacacatccgagacgtacaggactagatcggactgagtcgctaggtatcgtagaagacgacggtctagtgtaattacgtggttagtagagtactacggtagggtagggacgtccgtaccggtcctaccggtaccgtagggttccggggacccgtaacgggggtccccgtacggtaccgtaccccgttcgtccccg

SEQ ID NO: 353921 - DNA, 589 bp, Homo sapiens
  misc_feature: GZ8MTXP02FYMCC.25.75.G09.1.454.CMB.2.raw
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagccgtggggcctcagtgaaggtttccngcaaggcttctggatacaccttgcaagtcatgctcttcagttgggtncgccaggcccccganagggcttgngtgagtgggatggatcaacnctgaccaagtggtaaatgacaaaactcgtacgacccaagaaactccccgaagggccaggacgtactaacgttttaccgaggggaacacgtactcccgagaacgtaacgaggcttaacgagtcggaactggagtcgccttagggtactctaggaaacgacgtagggaccttaagtggttaattacgtgtgtagagtatacgagggttgggactcgtcgtaccgtcgacctaggtcggggaccgtacggggtaccctcgggtacctaccggtctcccg

SEQ ID NO: 353922 - DNA, 540 bp, Homo sapiens
  misc_feature: GZ8MTXP02IWFWP.25.75.G09.1.454.CMB.2.raw
  modified_base (266)..(266): a, c, t, g, unknown or other
  misc_feature (266)..(266): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggtncgccacggcccccgganaagggctgagtggatgggatggatcaacnctgaccaagttggtaaatgacaaactctcgacccagaaaactcccgaagggcagacgtcacgtttacagggacacactccgcgatacgagctagatggactgagtgctggtatcgtagagacaggtctagtgtattacgtagtgtagagataacgtggtagggcgtcgtcgtcctacgccgtaggttcggggccgtacgggacccttgggtacctcccggtcttcccg

SEQ ID NO: 353923 - DNA, 587 bp, Homo sapiens
  misc_feature: GZ8MTXP02IVDDQ.25.75.G09.1.454.CMB.2.raw
  modified_base (410)..(410): a, c, t, g, unknown or other
  misc_feature (410)..(410): n is a, c, g, or t
  modified_base (506)..(506): a, c, t, g, unknown or other
  misc_feature (506)..(506): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggtcgcgccgacggccccccggtagaagggcttgaggtggagtgggatggaatcaaacactgacctaatcggtaaatgacaaactctcgacccaagaaactcccgaagggcaggactactacggtttactaggggacacgatccgngaagtacaggctaacagtcggaccttggagtcgccgtagggtatcgtagaaacgaccgagggactagtgttattacgtgtgtacgagtacgtaagngggttggggatccgtcgtccgtacgccgttaggtcggggacccgtacgggggtacccgttggtaccctccggtcctacccg

SEQ ID NO: 353924 - DNA, 605 bp, Homo sapiens
  misc_feature: GZ8MTXP02GCCR7.25.75.G09.1.454.CMB.2.raw
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttgcaagtcatgctcttcattgggtncgccgacggcccccgganagggcttgagtggagtgggatggatcaacactgaccaagtggtaaatcgactaaaactctacgaccccaaagaaactcccgaggggacagacgtactacgtttacgtagggacacatccgacgagtaacgaggactacgagtcggacctgagtcggccttagggtactcgtaggaaacgacgacgggtacttagtgtttaacttacgttggtagttagagtaataacgaggggttaggggactcgttccggtccctacggaccttagggttcgggggaccgtacgggggtaccccttgggtcccaccggttcgtacccg

SEQ ID NO: 353925 - DNA, 662 bp, Homo sapiens
  misc_feature: GZ8MTXP02GVKVN.25.75.G09.1.454.CMB.2.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctgggctgagtgaagagcgtgggcctcagtgaaggtttcctgcaaggcttctggactacaccttgacaagtcatgctcttcagttgggtncgccaggcccccganaggcttgagtggatgggatggatcaacnctgcctaagttggaaatcgactaaacgtntacgacccaagtaaactcccgaagggcaggtacgtacgtaaaccgtttacgacgggaacacgtacgtcccgacgtacggtaacgaggtacctagtacgtcggggtacctaggtacggtcggtaccgttagggtaactccgtaggaaacgtacccgagggtccttaagttgttaagttccgtggttagtacggtaagtaccgtttaaacggagggtttacggggacgtcccgttaaccggtcccgtaccggtacccgttagggtttaaccgggggaccctaacgggggtaccccttcgggtaccctaccggtttccctacccgg

SEQ ID NO: 353926 - DNA, 601 bp, Homo sapiens
  misc_feature: GZ8MTXP02GULWN.25.75.G09.1.454.CMB.2.raw
  modified_base (284)..(284): a, c, t, g, unknown or other
  misc_feature (284)..(284): n is a, c, g, or t
  modified_base (462)..(462): a, c, t, g, unknown or other
  misc_feature (462)..(462): n is a, c, g, or t
  modified_base (507)..(507): a, c, t, g, unknown or other
  misc_feature (507)..(507): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttgcaagtcatgctcttcattgggtgcgccaggcccccgganaagggcttggagtggatgggatggatcgaacactgaccaagtcggtaaatgactaaactactgaccctaagaaactcccgaagggcagacgtctacgtttacgagggtacagacgtaccgcgaacgtacacggtactacgagtacgggactcggtaagtcgggtaccgtagggttacncgttacggaagaaccgacgggtacttaattagttaattacgttgnggttagagtaatacgagggtagggacgtcgtcgtaccgtcgaaccgtaggttccggggcgacggggtaccctggtaccgtacccggtctccccg

SEQ ID NO: 353927 - DNA, 589 bp, Homo sapiens
  misc_feature: GZ8MTXP02F37OM.25.75.G09.1.454.CMB.2.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (283)..(283): a, c, t, g, unknown or other
  misc_feature (283)..(283): n is a, c, g, or t
  modified_base (458)..(458): a, c, t, g, unknown or other
  misc_feature (458)..(458): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctgggcctnagtgaaggtttccngcaaggcttcnggatacaccttgcaagtcatgctcttcattgggtgcgccaggccccccgganaagggcttggagtggagtgggatggatcaacactgacctaagtggtaaatgacaaactactagcccaagaaacgtcccagggccagacgtcgtaaacgtttacgagggacacgatccgacgagtacaggctacatggacctgagtgccgtaggttatcgtagaagacgaccgggntaagttgttattacgttaggtgttagacgtagtacgtaagggtggggtacgcgttaccgtccgttacgaccgtacggttcgggggacccctagggggtacccccgtggggtacctacccggtccttccccg

SEQ ID NO: 353928 - DNA, 725 bp, Homo sapiens
  misc_feature: GZ8MTXP02GZCWN.25.75.G09.1.454.CMB.2.raw
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaggtttcctgcaaggcttctggatacaccttcgcaagtcatgctcttcagttgggtgcgccgacggcccccggacaagggcttgaggtggatggggatggatcaacactgaccaagtggtaaatgactaaactatacgacccaagaaactcccgaggggcaggacgtacctacgtttaacgagggaccaacgacgtacccgaggtaacggttaaccgaagggtaccttaacgaacgttcggggtaacccttagggtaacgggtcggggtacccgttaggggttaaacttccgttaagggaaacgtaaccggaacggggtacctttaagttgtttaaacgtttacgttgggttaggttacggtaaggtaacgttaacgggtaaggggttagggggaacgtaccggttacccggttcccgtaccgggtaaccccgttaagggtttccggggggaacccggtaccggggggtacccccgttcgggttacccctacccggggttccctttcccccgg

SEQ ID NO: 353929 - DNA, 661 bp, Homo sapiens
  misc_feature: GZ8MTXP02IATQX.25.75.G09.1.454.CMB.2.raw
  modified_base (295)..(295): a, c, t, g, unknown or other
  misc_feature (295)..(295): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtcgtggggctgaggtgaagaagcctggggcctgagtgaaggtttcctgcaaggtcttcgtggactactaccttcgcaagtcatgctcttcagttgggtgccgccgacggccccccgganagggccttggaggtggagtgggactggactcgaaactacgtgacctaagtaggtaaatcgactaaaactgtaccgacccgtaaagaaaacctcccggaagggactacgggtaacgttacgtaaaccggttttaacgaacgggaccaactacgtacccgacgagtaaccgaggtacctaacgtagtaccggaaccgttggtacggtcggtaccgttagggtactttgaacggtaagaccgacggtactagtcgtatttacgtggtagagtaagactacggagggttcggggactccgtaccgttccgacggtaccgtaggtcggggacccggacggggtacctcggtacccgtacgtcccgtacccg

SEQ ID NO: 353930 - DNA, 646 bp, Homo sapiens
  misc_feature: GZ8MTXP02I3OBO.25.75.G09.1.454.CMB.2.raw
  modified_base (220)..(220): a, c, t, g, unknown or other
  misc_feature (220)..(220): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctgggctgaggtgaagaagcctggggcctcagtgaaggtttccngcaaggcttctggatacaccttcgcaagtcatgctcttcattgggtgcgccaggcccccgganaagggcttgagtggatgggatggatcaanactgccaatggtaatgcaaactatgaccctagaactccgaggcagngtctacgttactaggcacancccgcgagtacacggtacgtaacatacggggacctaggtacgtcgggtccgttacgggtagttaccgacgggttaaagtaacccggacggggtaaccttaacgttaggttaactttaccttggtacggttgtaaaggggtaactacggtacggggtagggggttacgaccggttcccgtttaacccgtaccgtacccgtacggtttaacgggggaccccgtaggggggtaacccccgtggttaccccggtacgtacccccgtttcccg

SEQ ID NO: 353931 - DNA, 651 bp, Homo sapiens
  misc_feature: GZ8MTXP02GXKNK.25.75.G09.1.454.CMB.2.raw
  modified_base (221)..(221): a, c, t, g, unknown or other
  misc_feature (221)..(221): n is a, c, g, or t
  modified_base (269)..(269): a, c, t, g, unknown or other
  misc_feature (269)..(269): n is a, c, g, or t
  modified_base (289)..(289): a, c, t, g, unknown or other
  misc_feature (289)..(289): n is a, c, g, or t
  modified_base (320)..(320): a, c, t, g, unknown or other
  misc_feature (320)..(320): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagagccgtggggcctcagtgaaggtttccngcaaggcttctggatacaccttcgcaagtcatgctcttcagttgggtnccgcccgacggcccccgganagggcttggagtggagtgggatggatcaacnctgacctaagtggtaaatgactaaactcgtacgacccaagaaacctcccggaagggaccaggtacgttacgtaaccggtttacgacggggaacacgacgtcccgagtacgtaacacggactacgagtcggactgtacgtcgaccgttagtatcgtaggaagtacgtacgggtacttaagtcgttattacgtagttggtagtaagtacgtaacggtaggggtcggggtaacgtccgttccggttcccgtaaccggtaccggttaacgggtcgggggtacccggtaaccgggggtccccgttacgggtaccccgtacccggtcgttacccccg

SEQ ID NO: 353932 - DNA, 636 bp, Homo sapiens
  misc_feature: GZ8MTXP02JIFRR.25.75.G09.1.454.CMB.2.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (516)..(516): a, c, t, g, unknown or other
  misc_feature (516)..(516): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtcgtggggctgaggtgaagagcgtgggcctnagtgagttcngcaaggtcttcgtggatacaccttcgcaagtcatgctcttcagttgggtcgccgccgacgggcccccggagtaacgggtcttggaggtggagtggggatggactacaacgacgtgacctaagttaggtaatcgaactaaactctcgaacccaagaactcccggaagggacagggtacgtaccgtaacggtttacgaaggggaacctacgtacgtacccgacgtaacgtacgacggtactacgagtacggaccgtaggacgttcggacttagggtactagtacggaacgtacgtacggtntaacgttgtattacgtgtagtagtaacgtatacggaggttcggggactccgtccgtaccgtacgtaccggtaggtccggggtaccgacgggggtccctacggtaccgtccggtcctaccg

SEQ ID NO: 353933 - DNA, 565 bp, Homo sapiens
  misc_feature: GZ8MTXP02JNI03.25.75.G09.1.454.CMB.2.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
  modified_base (399)..(399): a, c, t, g, unknown or other
  misc_feature (399)..(399): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagagcctggggcctcagtgaaggtttcctgcaaggcttnggatacaccttcgcaagtcatgctnttcattgggtncgccaggcccccgganaggggcttgagtggatgggatggatcaanactgccaaatggtaaatgactaaactactcgaccccaagaaactcccgaggggacaggtagtctacgtttaccagggaacacatcccgngtaagtacaggcacgatcggacctggagtggcctaggtatctagaagcacggtactatcgtaattacgtgtagtagtaagattaacgaggtgggacgtcgtcgtcccgtacggacctaggttcggggcccgtaaacggggtccctgggtacctacccggtctcccg

SEQ ID NO: 353934 - DNA, 569 bp, Homo sapiens
  misc_feature: GZ8MTXP02JN07S.25.75.G09.1.454.CMB.2.raw
  modified_base (286)..(286): a, c, t, g, unknown or other
  misc_feature (286)..(286): n is a, c, g, or t
  modified_base (343)..(343): a, c, t, g, unknown or other
  misc_feature (343)..(343): n is a, c, g, or t
  modified_base (403)..(403): a, c, t, g, unknown or other
  misc_feature (403)..(403): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgcccaggccccccgganaagggcttgagtggatgggatggatcgaacactgaccaatggtaaatgacaaaactntacgaccccaagaaaactcccgaagggcagagtcaacgtttacgagggacacactcccgngagtacaggctaacgatcgacctgagtgcctggtatcgtagaagacacggactagtcgtattactgtgttagagacgtacgaggtggggactcgtcgttcccgtacgaccgtaggttcgggggcccgtaacgggggtaccctcggttccaacccggtcgtaccccg

SEQ ID NO: 353935 - DNA, 658 bp, Homo sapiens
  misc_feature: GZ8MTXP02JQPCO.25.75.G09.1.454.CMB.2.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtgggcctnagtgaaggtttccngcaaggcttctggatacaccttcgcaagtcatgctctcattggtncgccacggcccccganagggctgagtggagtgggatggaatcgaacacgtcgaccaagtggtaaatcgaactaaaactacgtccgaaccctaagaaaaccgtcccgaaggggcaggtacgttactaaacggtttacgaagggtaccacgactacccggagtaacgtacgaggtctaaccgtagtacggaccgttaggaggtcggtccgttagggtacttaccgagaaacggaccgaccgggttactaagtttagttaacgtttaacgtggttagtaggtaacgaacgttaacggtaggggttacgggggtaactccggttccgtacccgtaccgtacgtaacggttcgggggaccctacgggggtaccctggtccgtacccggtcttccccg

SEQ ID NO: 353936 - DNA, 631 bp, Homo sapiens
  misc_feature: GZ8MTXP02IZ8KZ.25.75.G09.1.454.CMB.2.raw
  modified_base (287)..(287): a, c, t, g, unknown or other
  misc_feature (287)..(287): n is a, c, g, or t
  modified_base (319)..(319): a, c, t, g, unknown or other
  misc_feature (319)..(319): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagagcctggggcctcagtgaaggtttcctgcaaggcttcgtggatacaccttcgcaagtcatgctcttcattgggtgcgccgacggccccccgganaagggcttgaggtggagtgggatggatcaacncgtgcctaaagtggtaaatggaacctaaaactactacgacccaaagaaaacctccccgaaggggaccaggtacgttacctaaaccggttttaacgaacggggaaccaacgtacgtacccgacgaacgtaacgaggacctaacgagtcggaaccgtggaacgtcgggccttagggtacttcgtaggaacgaccacgggtactagtcgttaattacgtgttgtagacgtatacgaggtagggacgtcgttacgtccgtacgacctaggttccggggaccgaacggggtcccctaggtaccctccggtcctcccg

SEQ ID NO: 353937 - DNA, 636 bp, Homo sapiens
  misc_feature: GZ8MTXP02HK3QU.25.75.G09.1.454.CMB.2.raw
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (318)..(318): a, c, t, g, unknown or other
  misc_feature (318)..(318): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctggaggtgaagaagcctggggcctcagtgaaggtttcctgcaaggtcttctggataccaccttgcaagtcatgctcttcattgggtncgccacggcccccgganagggcttgagtggagtgggatggatcaacncgtgaccaagttggaatgactaaactactcgaccaagaaactcccgaggggacaggtacgttacgtaaccggttttacgacggggtaacacgtacgtaccggacgtaacgtacgacggtactaacgagtcggactggagtcggccttagggtactgtaggaacgacgaggtacttagtggttacttacgtaggttgtagtaagacgttacggagggttaggggacgtccgttccgtacccgtacggtaccgttacgggtccgggggtaccggtaaccgggggtacccgttcggtacccgtacccggttccgtaccccg

SEQ ID NO: 353938 - DNA, 587 bp, Homo sapiens
  misc_feature: GZ8MTXP02GEE5X.25.75.G09.1.454.CMB.2.raw
  modified_base (223)..(223): a, c, t, g, unknown or other
  misc_feature (223)..(223): n is a, c, g, or t
  modified_base (289)..(289): a, c, t, g, unknown or other
  misc_feature (289)..(289): n is a, c, g, or t
  modified_base (321)..(321): a, c, t, g, unknown or other
  misc_feature (321)..(321): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctggaggtgaagagccgtggggcctgagtgaaggtttccngcaaggcttctggatacaccttcgcaagtcatgctcttcagttgggtgcgccgacggcccccgganaagggcttggagtggagtgggatggatcaacnctgaccaagtggtaaatgacaaactcgacgacccaagaaactcccgaagggacagagtctaacggtttacagggacacgatccgngaagtacgaggctanagtcggacctggacgtcggcctagggtactcgtaggaacgtaccgacgggtactagttagtattacgtgtgtagagtatacgaggtggggactcgtccgtcctacgtaccgtaggttcgggggcccgtaagggggtaccccgtggtaccgtacccgtcgtaccccg

SEQ ID NO: 353939 - DNA, 565 bp, Homo sapiens
  misc_feature: GZ8MTXP02GNOJT.25.75.G09.1.454.CMB.2.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (417)..(417): a, c, t, g, unknown or other
  misc_feature (417)..(417): n is a, c, g, or t
  modified_base (451)..(451): a, c, t, g, unknown or other
  misc_feature (451)..(451): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggccccccgganaagggcttgngtggagtgggatggatcgaacactgcccaatggtaaatgacaaactatcgacccagaaaactcccaaggggcaggagtactaacgtttacaggggaacacactaccgcgagtacaggctanatgactgagtgctggtatctagaagacacgggtntacgtgttattacgtgtgttagagtatacgaggtaggggatcgtccgttaccgtcgtaccgtacgttgggggacccacgggggtacccctcggggtaccctccggtccttcccg

SEQ ID NO: 353940 - DNA, 707 bp, Homo sapiens
  misc_feature: GZ8MTXP02IRDIG.25.75.G09.1.454.CMB.2.raw
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctnagtgaaggtttcctgcaaggcttctggataccaccttcgcaagtcatgcttcttcagttgggtcgccgccgacggccccccggaanaacggggtcttaggaggtggagtgggatggatacaacgactcgaccaagttggtaaatcgaacaaaacttacgtcgaccccaagtaaacctcccgaagggacacggacgttaccgtaaaccgttttacgaaggggaaccacgtacgtacccgagaacgtacgacggtactaacgaagtcggtaacctgggaacggtcggtaccgttaggttacgtacgtaacggaaaccgtaaccgtacgggtacttaagttacgtttaacgtttaacgtggttagttaaggaaggtaaacgtttaacgggacggggttagggggaacgttcccgtttaaccggtcccgtaacggtacccggttaaggttcccgggggaccggaaccggggtcccgtcggtaccccgtccggttcctaccccg

SEQ ID NO: 353941 - DNA, 648 bp, Homo sapiens
  misc_feature: GZ8MTXP02ITY1R.25.75.G09.1.454.CMB.2.raw
  modified_base (207)..(207): a, c, t, g, unknown or other
  misc_feature (207)..(207): n is a, c, g, or t
  modified_base (268)..(268): a, c, t, g, unknown or other
  misc_feature (268)..(268): n is a, c, g, or t
  modified_base (322)..(322): a, c, t, g, unknown or other
  misc_feature (322)..(322): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcgtggggcctnagtgaagtttcctgcaaggcttctggatacaccttcgcaagtcatgctcttcagttgggtncgccgacggccccccggagacgggtcttggaggtggagtggggatggatcaacnctgactaatggtaaatgacaaacttatcgacccaagaaaactccccgaaggggaccaggtacgtctaaacggttttaccagggggtaaccacgtactacccggacgaacgtaacgacgggaccttaaccgagttccgggacctggaacgtcggccgttaggtacttcgaggaagaccgacgggactagttagttatttacgtggttgtacggagtaacgtacgagggttaggggacgtcgttccggttcccgtacggtacccgtaaggttccgggggacccgtaacgggggtcccccttggggtacccctccggttacctccccgg

SEQ ID NO: 353942 - DNA, 673 bp, Homo sapiens
  misc_feature: GZ8MTXP02HYPGM.25.75.G09.1.454.CMB.2.raw
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
  modified_base (320)..(320): a, c, t, g, unknown or other
  misc_feature (320)..(320): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttccngcaaggtcttctggatacaccttcgcaagtcatcgcttcttcattgggtncgccgacggcccccggagaacgggctgagtggagtgggatggatcaacnctgcaagtggtaatcganaaactntacgacccaagaaaactcccgaagggacacggtagtacctaacggtttaccgtaaggggaacaccgtacgtacccgacgtaacggtaaccgagggacctaaaccgtagtaccggtacccgttaggggtaacgtcgggtacccgtagggtttaactccgttaagggaaacgtaccgaacgggtaccttaaagtcggttaatttacgtgggttagtaaggtaagtacgtaacgggtaacggttgggggaacctcgttaccgtcccgtacggaccgtaaggttcggggcccgtaaccgggggtacctacggtcccgtaccggttccgtcccg

SEQ ID NO: 353943 - DNA, 698 bp, Homo sapiens
  misc_feature: GZ8MTXP02JJN7W.25.75.G09.1.454.CMB.2.raw
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (287)..(287): a, c, t, g, unknown or other
  misc_feature (287)..(287): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcagtgaggtttccngcaaggcttnggatacaccttcgcaagtcatgctcttcagttgggtgcgccgacggccccccgganaacgggcttgaggtggagtgggatggatcgaacacgtgacctaagtggtaaactgaacctaaatctacgacccaagaaactccgaagggcagtacgtactacggtttacgacgggaactacgtacgtacccgacgtaacggtacgacggacttaaccgagtaccggggtaacgttcggtaacggtccggggtaccgttaggggttaacctacggttaaacggtaacggaacggttacccgggtactttaagttaccgtttaagtttaaccggtgttaaggaggtaagtaacggtacggtagggggttcggggacttccggtaaccggttcccgtacggtacccgttagggggtccggggtacccgggaaaccgggtccccgtcgggtacccttaacccgggtcctccccgg

SEQ ID NO: 353944 - DNA, 663 bp, Homo sapiens
  misc_feature: GZ8MTXP02JKSJW.25.75.G09.1.454.CMB.2.raw
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
tcagactgtacagtcacgaccggtgctcgatttagtatagacatcagggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagagcctgggcctcagtgaagtttccngcaaggcttcgngatacaccttcgacaagtcatgcttcttnattgggtncgccacggcccccgagaggctggagtggagtggggatggactacgaacacgtacggacctaaagttcgggtaaactggaacctaaaacttaccgacggaccccctaaagaaacctccccggaaggggaccaggtacgttactaaccggttttacgaagggtacacgacgtcccgacgtaagtaacgacggtactaacgaagtccggaaccgtggtacggtcggtaccgttagggtactcgtaaggaacgacgacgggtattaagttagtatttacgtaggttgtagtagtaacctacgggagggtggggaacgtcgttacggtacccgtacgtaccggtaacggttccgggggtaccaccgggggtacctcgggtaccgtacccggtcgttcccg

SEQ ID NO: 353945 - DNA, 636 bp, Homo sapiens
  misc_feature: GZ8MTXP02G3J9Y.25.75.G09.1.454.CMB.2.raw
  modified_base (233)..(233): a, c, t, g, unknown or other
  misc_feature (233)..(233): n is a, c, g, or t
  modified_base (287)..(287): a, c, t, g, unknown or other
  misc_feature (287)..(287): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttcnggatacaccttcgcaagtcatgctcttcattgggtgcgccgacggcccccgganaacgggcttgagtggatgggatggatcaacatgaccaagtggtaaatgactaaactactacgaccaagaaactcccgaagggcaggacgtactaacgtttacgtaggggaacacgacgtacccgacgacgttaacacggactaacgtagtcgggaacccttggaacgttcgggccttagggtactacgtaggaaagtacgaacgggtcttaagtaggttacttagttgtggtagagtaagttacgaagggttggggacgcgttccggttaccgtaccggaaccttacgggttcgggggacccgacggggggtaacccttcgggtacccctacccgggttcttcccccgg

SEQ ID NO: 353946 - DNA, 674 bp, Homo sapiens
  misc_feature: GZ8MTXP02IBERC.25.75.G09.1.454.CMB.2.raw
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtcgtggggctgaggtgaaggaagcctggggcctcaggtgtaaggtttcctgcgaaggcttctggatacaccttgcaagtcatgctctngtgggtnccgccgacggcccccgganaacgggtcttggngtggagtgggatggatcaacnctagccaagtggaatcgactaaactacgtacgacccaagaaacctcccgagggctagtaacgtcgtaacgtttaacgaggggtaaccacacgtacccgcgaaggtaccgacggtaacctacgtagtcggaccgtaggacggttcgggccgtagggtacttcggtaaggaaacgaccgtagggtaccttagttacgttaattaggtgtttaggacgtagtaagttacggaggttcgggggaaacttccggtaccggttcccgtaacggtaccccggttaagggtttcccgggggaccccgtacgggggtaccccgtttcggggcccttaacccgggttccccttaccccgg

SEQ ID NO: 353947 - DNA, 596 bp, Homo sapiens
  misc_feature: GZ8MTXP02HGPXC.25.75.G09.1.454.CMB.2.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (518)..(518): a, c, t, g, unknown or other
  misc_feature (518)..(518): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccgctcccaggtccagcttgtgcagtctggggctgaggtgaagagcctggggcctcagtgaaggtttcctgcaaggcttctggatacaccttgcaagtcatgctcttcattgggtncgccaggcccccganaagggctgagtgatgggatggatcaacactgaccaatcggtaaatgacaaaactgtacgaccccaagaaactccccgaggggccaggagtacgtaacgtttacgaggggactacacgtcccgcgaaacgtacacgggtacctaaccgagttcgggaacccgtggaacgtcgggcccttagggtattcgtagaagaccacgggtctagtgttattacgtggtgtagagattaacgggnggtgggacgtcgttaccggtccgtaccgacgtaggtcggggaccgtacggggtacccgtcggtcccgtaccgtcctcg

SEQ ID NO: 353948 - DNA, 652 bp, Homo sapiens
  misc_feature: GZ8MTXP02GFNUL.25.75.G09.1.454.CMB.2.raw
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (274)..(274): a, c, t, g, unknown or other
  misc_feature (274)..(274): n is a, c, g, or t
  modified_base (328)..(328): a, c, t, g, unknown or other
  misc_feature (328)..(328): n is a, c, g, or t
  modified_base (556)..(556): a, c, t, g, unknown or other
  misc_feature (556)..(556): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcagtgaaggtttccngcaaggcttcgnggataccaccttcgacaagtcatcgctcttcagttgggtnccgccgacggcccccggagacgggtcttggaggtggatggggatggatacaacncgtcgacctaagtggtaatgaacaaacgtcaccgaccaagaaacctccgaagggacaggacgtacgtaacgtttacgacgggacacgtactcccgagaacgtacgacggtactaacgacgtcggaccgtagggtacgtcgggtaccgtagggttaccttagaacggaaacgaccggtaacgggtattagttagttaacgtttgtaggtggtagtaacgtagtaacggngggtacggggtactccggttcgtaccgacgttaaccgtggggttaaccgggaccggtacggggtacccgtacggtcccgtaccggtttcccgtccg

SEQ ID NO: 353949 - DNA, 542 bp, Homo sapiens
  misc_feature: GZ8MTXP02F0BDU.25.75.G09.1.454.CMB.2.raw
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (388)..(388): a, c, t, g, unknown or other
  misc_feature (388)..(388): n is a, c, g, or t
  modified_base (427)..(427): a, c, t, g, unknown or other
  misc_feature (427)..(427): n is a, c, g, or t
  modified_base (464)..(464): a, c, t, g, unknown or other
  misc_feature (464)..(464): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtncgccaggcccccganaagggctgagtggatgggatggatcaacactgccaaatggtaaatgacaaactatgcccagaaactcccagggcagagtcacgtttacgagggactacatccgngagtacaggctacagtggacctgagtggcctaggatcgngaagacagggctatgttacttatgtgtagagatacgnggtggggactcgtcgtccgtacgccgtaagttcgggggcccaagggggtaccccgtgggtaccacccggttctacccg

SEQ ID NO: 353950 - DNA, 560 bp, Homo sapiens
  misc_feature: GZ8MTXP02FHYBG.25.75.G09.1.454.CMB.2.raw
  modified_base (284)..(284): a, c, t, g, unknown or other
  misc_feature (284)..(284): n is a, c, g, or t
  modified_base (341)..(341): a, c, t, g, unknown or other
  misc_feature (341)..(341): n is a, c, g, or t
  modified_base (504)..(504): a, c, t, g, unknown or other
  misc_feature (504)..(504): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccganaagggcttgagtggatgggatggatcaacactgccaagtggtaaactgacaaaactntcgacccaagaaaactcccgaaggggctagacgtctaacggttttaacaggggacaacgatcccgacgaagtaccaggctaacagtggacctgagtggccctggtactcgtgaaggacaacgggcttagtgtacttacgtgtgtagagatacgaggtgggacnctcggtcctcgacctagtcgggggccacgggggaccccttggcctaccgtctcccg

SEQ ID NO: 353951 - DNA, 592 bp, Homo sapiens
  misc_feature: GZ8MTXP02JS391.25.75.G09.1.454.CMB.2.raw
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
  modified_base (265)..(265): a, c, t, g, unknown or other
  misc_feature (265)..(265): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtcgtggggctgaggtgaagaagccgtgggcctnagtgaagtttcctgcaaggtcttgngataccacttcgcaagtcatgctctcattggncgccaggccccgagagggtctgagtgagtggatggatcaacactagacctaagtaggtaaatacgactaaaacgtacgtacgaccccgtaaagaaaactcccgaaggggaccaggtaccgtacgtaacgtttaacgaggggaccacgtacgtaccgcgtaagtacgacggactacgagtacggacctaggagtcggctaggtatcgagtaacgacgaggtactagtagttacgttacgtggtagtagagtagtacggtaaggttggggactcgtcgtcgtaccgacgtagtcggacgtacgggaccgtcggcctaccggtctacccg

SEQ ID NO: 353952 - DNA, 613 bp, Homo sapiens
  misc_feature: GZ8MTXP02ID35Z.25.75.G09.1.454.CMB.2.raw
  modified_base (351)..(351): a, c, t, g, unknown or other
  misc_feature (351)..(351): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctgggctgaggtgaagagccgtggggcctcagtgtaaggtttcctgcaaggcttctggatacaccttgcaagtcatgctcttcagttgggtgccgccgacggcccccggagaacgggtcttaggagtggagtgggatggaatcaacactgactaagtggtaaatgacaaactancgacccagaaactccgagggcagatctaacgtttacgaggacactacgccgagaacgtacgacggtactacgagtacgggacctggagtcgacgtggttactcgtaggaaacgcgacgggtacttagtacgttagttacgttggtagtagagtaagttcggagggttagggacgtccgttacgtcccgtacgtacccgtaggttaaccgggggaccgtaacgggggtaccccttacgggtacccgtacccgttccgtccccg

SEQ ID NO: 353953 - DNA, 703 bp, Homo sapiens
  misc_feature: GZ8MTXP02GAZ88.25.75.G09.1.454.CMB.2.raw
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaagtttcctgcaaggcttctggatacaccttcgcaagtcatgctcttcattgggtncgccacggcccccgganaagggcttgagtggagtgggatggatcaacnctgccaagtggtaaangacaaactctcgacccaagaaactcccgaagggcaggtacgtacgtaacggttttaccgaggggaacctacgactcccgacgtaacgtacgaacggtctaaccgtagtcgggaacctggaacggtcggtcccgttaggggttaacttaccggtaggaaaacggaaccgtaacggggtaccttaaggttagtttaacgtttacgttaggttaggttagtaaggtaacgttaacggtaaggggttacgggggaaacgttccggttacccggttcccgttaaccgggaaccgttacgggtttaaccgggggaccccggtaacggggggtacccccttcggggttaccccgtaacccggtttcccgttaaccccgg

SEQ ID NO: 353954 - DNA, 652 bp, Homo sapiens
  misc_feature: GZ8MTXP02I2A10.25.75.G09.1.454.CMB.2.raw
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctggggctgaggtgaagagcctggggcctcagtgaaggtttcctgcaaggcttctggatacaccttcgcaagtcatgctcttcattgggtncgccncggcccccgganagggcttgagtggagtgggatggatacaacacgtgaccaagtggtaaatgactaaacgtactcgaccccaagaaactcccgaagggccaggtacgttactaacgttttacgaacggggtaacacgacttacccgacgtaaggtaccgaggtacctaacgagtcggtacctggtaacgtcggtaccgttgggtatccgtaggaacgtacgacgggtacttaagtcggttaaacttcgtaggttagtaggtaagtactaaacggagggttacgggggtaactccggttcggtacccgttacggacccgttaagggttccgggggacccgttaacgggggaccccttggggtacccaccgttccgtacccg

SEQ ID NO: 353955 - DNA, 651 bp, Homo sapiens
  misc_feature: GZ8MTXP02GMBJK.25.75.G09.1.454.CMB.2.raw
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtctggggctgaggtgaagagccgtggggcctcagtgaaggtttccngcaaggcttctggatacaccttcgcaagtcatgctctcattgggtncgccacggccccgagagggctgagtggatgggatggatcaacgctgacctaagtggtaaatgactaaactacgtcgacccaagaaaacctccgaagggcagagtctaacgtttacgaggacacgactccgacgaagtacgagtactaacgtagtcggtaccgtggaggtcgccgttaggtactacgtaggaacggacgtacgggtacttaagttacgttaagtttacgtaggttaggtaggtaaagtaacgttaacggtaaggggttcgggggtaacgtaccggttccggtacccgttaccggaaccggttacgggtttaaccgggggacccgtaaccgggggttaccccgttcggtaccgtaccccggtttaccttccccg

SEQ ID NO: 353956 - DNA, 723 bp, Homo sapiens
  misc_feature: GZ8MTXP02IYAGJ.25.75.G09.1.454.CMB.2.raw
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctgggctgaggtgaagaagccgtggggcctcagtgaaggtttcctgcaaggcttctggatacaccttcgcaagtcatgctcttcagttgggtcgccgcccgacggccccccggacgaaggggtcttggaggtggagtggggatgggaactcaaacgctcgacctaaagtggtaaatacggactaaaactacgtacgaccccgtaaagaaaacctccccggaagggaccaggtacgtaccgtaaacggtttaccgtaaaggggtacaaccgtataccccggacgtaacggttaaccgaacgggtaccttaacgaacgttcgggaaaccgttgggaacggtcgggtccgtttagggtacttcgtaacggaagacccgtacgggtacttaagttgttaacgtttacgtgttaggtaggtaagacgtttaacggaggggttcgggggaacgtccgttaccggttcccgtaccggtaccgtaacgggttccgggggaacccggtacgggggtacccccgtacgggtacccgtaacccggttcccttacccg

SEQ ID NO: 353957 - DNA, 549 bp, Homo sapiens
  misc_feature: GZ8MTXP02F2263.25.75.G09.1.454.CMB.2.raw
  modified_base (284)..(284): a, c, t, g, unknown or other
  misc_feature (284)..(284): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtgggcctcagtgaaggtttcctgcaaggcttctggatacaccttcgcaagtcatgctcttcattgggtgcgccacggcccccganagggcttgagtgagtgggatggatcaacactgaccaagtcggtaaatgactaaactatcgacccaagaacctcccgagggcagagtctaacgtttacgagggacacgactccgagagtacaggctacatcggactgagcgcctggtatcgtagaacgtacgacgggtacttaatcgttattacgtggtgtagagtaagtacgaggttggggactcgtcgtccgtcgacctagtcggacgacgggtccgtaggtaccgcgtctccg

SEQ ID NO: 353958 - DNA, 626 bp, Homo sapiens
  misc_feature: GZ8MTXP02G7PGJ.25.75.G09.1.454.CMB.2.raw
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgccccactcccaggtccagcttgtgcagtcgtggggctgaggtgaagaagccgtggggcctcagtgaaggtttcctgcaaggcttcgtggatacaccttgcaagtcatgctcttcagttgggtgccgccgacggccccccggaagaacgggcttaggaggtggagtgggatggaatcgaaactacgtagacccgaaagttgggtaaatcggactaaaactagtacgacccaagaaactcccgaaggacagagtactaaccgtttaacgagggacaacgtactcccgacgaagtacgacggactacagtcggacctaggacgtgtccgtaggtactagtagaagacgacggtactagttagtattacgtgttagtgaagagttacgagggtggggactccgttaccgtccgtacggtaccgtacggttaaccggggccgaaacggggtcccgtacggtccgtacccggttcttccccg

SEQ ID NO: 353959 - DNA, 567 bp, Homo sapiens
  misc_feature: GZ8MTXP02JHP68.25.75.G09.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (406)..(406): a, c, t, g, unknown or other
  misc_feature (406)..(406): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctctcattgggtncgccacggcccccgganaagggcttggagtggagtgggatggatcaacactgaccaagtggtaaatgacaaactagtcgacccaagaaactccccgaagggacagacgtcaacgtttacgagggactaacagtcccgngacgtacaggctaacgatacggacctggagtcggccgttggtatcgtaggaacgacacggtatagtgtaattacgtgtgtagacgtatacggaggtaggggactcgtcgtcgtcgaccgtaggtcgggaccgtacgggcccgttggccgtaccgtctcccg

SEQ ID NO: 353960 - DNA, 806 bp, Homo sapiens
  misc_feature: GZ8MTXP02IH6BE.25.75.G09.1.454.CMB.2.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctgggctgaggtgaagaagcctggggcctcagtgtaaggtttcctgcaaggcttctggatacaccttcgacaagtcatgctcttcatggtnccgcacggccccganacgggctgagtggagtgggatggatcgaacactagacctaaagtgggtaaatcggaactaaaacgttactaccggacccccaagtaaaacctacccggaaggggacacgggtacgttaaccgtaaaccggttttaacgtaacgggggtacctaaacgtaccgtacccgtacggaaacggttaacccgagggtaccttaaaccgagttaccggggtaacctagggtacggttacggggtacccgttagggttaaccgttcgtaaacggtaaacggtaaacccgtaccggggtaacctttaaggttaacggtttaaacgtttaaccgtagggtttacggtaacgggtaaaagtaacgtttaaaccggaagggggttacgggggtaaacgttcccggttaaccccggtttaccccgttaaccggtaacccgttacggggtttaacccggggggacccggttaaacccggggggtaccccgttaccggggtttaccccgtaaaccccggtttccgtttaaccccccgg

SEQ ID NO: 353961 - DNA, 644 bp, Homo sapiens
  misc_feature: GZ8MTXP02HOVLO.25.75.G09.1.454.CMB.2.raw
  modified_base (224)..(224): a, c, t, g, unknown or other
  misc_feature (224)..(224): n is a, c, g, or t
  modified_base (331)..(331): a, c, t, g, unknown or other
  misc_feature (331)..(331): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtcgtggggctgaggtgaagagccgtggggcctcgagtgaaggttttccngcaaggcttctggactactaccttcgcaagtcatgcttcttcagttgggtcgcgcccgacggccccccggagaacgggtccttggagtggagtgggatggatcaacnctgaccaagttggtaaatgacaaactcgtcgacccagaaaactcccgaggggcaggtagttactaacgtttacgaacgggtacaacgtacgtaccgacgaacgtacgacgggacttaacgagtacggaccctggtacggtcggtacccgtggttaacgtcgtagaaacgacgacggtcttagtcgttaacgttgtggtttagagtagtaacgttacgggaggtttagggggactccgtacggttccgtaccggtaacctaggggttccgggacggtaacgggggtccctacgggtcctacccggttcctcccg

SEQ ID NO: 353962 - DNA, 688 bp, Homo sapiens
  misc_feature: GZ8MTXP02J1R0N.25.75.G09.1.454.CMB.2.raw
  modified_base (286)..(286): a, c, t, g, unknown or other
  misc_feature (286)..(286): n is a, c, g, or t
tcagactgtacagtcacgaccggtgctcgatttagtatagacatcaggggacccaacaaccacatccctcctcagaagccccagagcacaactcctcaccatggactggacctggaggatcctcttttggtggcagcagccacaggtgcccactcccaggtccagcttgtgcagtctggggctgaggtgaagaagccgtggggcctgagtgtaaggtttcctgcaaggcttctggatacaccttcgcaagtcatgctcttcattgggtgcgccacggcccccgganaacgggcttggagtggagtgggatggaatcgaacacgtgacctaagtggtaaactggactaaaacgtcgtacgacccaagtaaaacctcccgaagggaccaggtacgtacgtaaccgtttagaacgggaacctaacacgttcccgacgtaagtaccgacgggtactaacgagttcggaacccgttggaacggttcggcccgttggggttaaactcggtaacggaacgtacgtaaacccgggttattacgttagtttaacgttacgtggttaggtagtaacggtacggttaacggtaggggttacggggacgttccgttaccggtaccgtaccggtaccggttacgggttccggggaccggtaccggggtacccgttcggtacccgtaccggttcccgtaccg

SEQ ID NO: 353963 - DNA, 609 bp, Homo sapiens
  misc_feature: GZ8MTXP02I66S2.25.75.G09.1.454.CMB.2.raw
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (316)..(316): a, c, t, g, unknown or other
  misc_feature (316)..(316): n is a, c, g, or t
  modified_base (344)..(344): a, c, t, g, unknown or other
  misc_feature (344)..(344): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctgggctgaggtgaagaagcctggggcctcagtgaaggtttcctgcaaggcttctggatacaccttcgcaagtcatgctcttnattgggncgccaggcccccgganaacgggtcttgagtggagtgggatggatcaacntcgaccaagtggtaatcgaactaaactntacgaccctaagaaactcccgaagggcaggacgtactaacggtttaccgagggaaccactacgtccgcgaaagtacgaggtacctaacgacgttcggaactggacggtcggcccgttagggtaacttcggtaggaacgaccgtacggtacttaagtcgttattacgtgtggtagagtaagttacggagggttggggactcgtacggtcctacggtacaggttcgggggaccacgggggtaccctgggtcccacggttcctacccg

SEQ ID NO: 353964 - DNA, 601 bp, Homo sapiens
  misc_feature: GZ8MTXP02JGH33.25.75.G09.1.454.CMB.2.raw
tcagactgtacagtcacgaccggtgctcgatttagtatagacatcaggggacccaacaaccacatccctcctcagaagcccccagagcacaactcctcaccatggactggactggaggatcctcttttggtggcagcagccacaggtgcccactcccaggtccagcttgtgcagtctggggctgaggtgaagaagccgtggggcctcagtgaaggtttcctgcaaggcttctggatacaccttcgcaagtcatgctcttcagttgggtgcgccgacggcccccggagaagggcttgaggtggagtgggatggatcgaacactgacctaagtggtaaatgaactaaaactataccgacccaagaaactcccgaaggcaggtagtacctacggtttaacgagggacacacgtaccgcgaagtacgaggctaacgagtcggacctggtagtcggaccgttagggtatacgtagaacggtaaccgacgggtacttagtagttattacgtaggttgtagagtatacggtagggtggggactcgtcggtcctacggtaccgtaggttcggggaccgtacggggaccctcggtcctaccggtctcccg

SEQ ID NO: 353965 - DNA, 637 bp, Homo sapiens
  misc_feature: GZ8MTXP02H06HA.25.75.G09.1.454.CMB.2.raw
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
  modified_base (526)..(526): a, c, t, g, unknown or other
  misc_feature (526)..(526): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctcagtgaaggtttccngcaaggtcttctaggataccaccttcgctaagtcatgcttcttctattgggtncgccgacggcccccgganaagggtcttgagtggatggggatggatcgaaacgcttagacctaaagttgggtaaatacggactaaaacgtcgtcgaaccccaaggaaaacctcccgaaggggcacggtacgtaccgttacgttacgaggaccaacacgtacccgagagtaacacggactaacgagtccggacttggacgtcgtaccgttaggtacttacgaggaacgacgtacggcttaagtgttatttacgngttgttagagtagttacggagggttcggggactcggttccctccgttacgaacccgtgggttaaccggggccgaacgggggtcccttacgggccttacccgtccgtacccg

SEQ ID NO: 353966 - DNA, 513 bp, Homo sapiens
  misc_feature: GZ8MTXP02FHZH2.25.75.G09.1.454.CMB.2.raw
  modified_base (286)..(286): a, c, t, g, unknown or other
  misc_feature (286)..(286): n is a, c, g, or t
  modified_base (358)..(358): a, c, t, g, unknown or other
  misc_feature (358)..(358): n is a, c, g, or t
  modified_base (468)..(468): a, c, t, g, unknown or other
  misc_feature (468)..(468): n is a, c, g, or t
tcagactgtacagtcacgaccggtgctcgatttagtatagacatcagggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccgganaagggcttgagtggatgggatggatcaacactgccaatggtaatgcaaactatgcccagaaatcccagggcngagtcacgtttactagggacacatccgcgagtacaggctacatggacctgagtggcctggtatctgaagacacgggctatgtattactgtgtgagatacgagtggggganctcgtcctcgaccagtggggccaggggaccctggtcaccgtctcc

SEQ ID NO: 353967 - DNA, 582 bp, Homo sapiens
  misc_feature: GZ8MTXP02G93M6.25.75.G09.1.454.CMB.2.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (340)..(340): a, c, t, g, unknown or other
  misc_feature (340)..(340): n is a, c, g, or t
  modified_base (451)..(451): a, c, t, g, unknown or other
  misc_feature (451)..(451): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtgggcctnagtgaggttcngcaggcttnggatacaccttcgcagtcatgcttntcagttgggtncgccacggccccganaggctgagnggatgggatggactacgaactctacgacctaattcgggaaatggactaaactntaccgacccaagtaaactcccgaaggggcctaggggacttacgtacgtttaacagggacactacgtcgcaagtacaggactacgagtcgactagtagtcggtacctaggtnttacgaggtaacgacgtacggacttagtattacgttagtgtcgtagagacttaggagtgggggcgtcgtcgtccgtacgacgtacggtcggtacggaccggtaccgtaccggtaccgtaccgtaccgtccg

SEQ ID NO: 353968 - DNA, 663 bp, Homo sapiens
  misc_feature: GZ8MTXP02G1L5O.25.75.G09.1.454.CMB.2.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (425)..(425): a, c, t, g, unknown or other
  misc_feature (425)..(425): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtcgtggggctggaggtgaagagccgtggggcctcagtgaaggtttccngcaaggcttcgnggatacaccttcgcaagtcatgctcttcagttcgggtgccgcccgacggtccccccggaagaacgggcttggaggtggagtgggatggatacaacgctcgacctaagttggtaaatgactaaactctacgacccaagaaacgtcccgaggacaggacgttacgacgtttacgagggacacgacgtccgngacgtacgaggactacagtcggaccgtgaggtacgccgttaggtacgtacgtacggaaaacgtacggtattaacgtgttaagttacgtggttagtaggtaagtaacgtacggtaagggtcggggtactccggttaccgtccggtccggtaaaccggtacgggtttaccgggggaacccggtaacgggggtaccccgttaggggtacccccgtaccggttaccccgtccgttaccccgg

SEQ ID NO: 353969 - DNA, 648 bp, Homo sapiens
  misc_feature: GZ8MTXP02JA5VH.25.75.G09.1.454.CMB.2.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtctgggctgaggtgaagagcctggggcctcagtgaaggtttcctgcaaggcttctggatacaccttcgcaagtcatgctcttcattgggtncgccaggcccccganagggcttgagtggatgggatggatcaacnctgccaattggtaaatgacaaatctacgaccccaagaaactcccgaagggccaggacgtaccgtaacggttttacgacggggaacaacgacgttcccgacgtacggtaaccagggtacccttaagaacgttcgggaacccttgggaacgttcgggccccttaggggttacctacgttacggaaagacccgtaaggggtccttaagtggttaaactttacgtggttaggttagaacgtagttaacggaggttacgggggactccgttccgtccgttacgacccgtaaggttccgggggaccgacgggggtaccctggtacctacccggttccgtacccg

SEQ ID NO: 353970 - DNA, 708 bp, Homo sapiens
  misc_feature: GZ8MTXP02FQAO1.25.75.G09.1.454.CMB.2.raw
  modified_base (224)..(224): a, c, t, g, unknown or other
  misc_feature (224)..(224): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcgagtggaaggtttccngcaaggcttctggataccaccttcgcaagtcatgcttcttcagttgggncgccacggccccganagggcttgagtggagtggagtggatcaacnctgaccaagtggtaangaccaaagtctcgaccaagaacgtccaggcagactcgtacgttacgacggacacgacgtcccgagaacgtacacgggctaacgtagccgggtaaccgtggtacgggtccgggtaccttaggggtttacgacggtaaacggtaaacgacccggtaaaccgggtacctttaacgttaggtttaacggtttaccggtttagggttacggttacgtaaggggttaaactaccggttaggggtttaaccgggggacgtttaccccggttccggtttacccgtacccccggaaggtttacgggggaacccggggtaccccggggtaaacccgggggttccccggtacggttccccgtaaccccggttccgtttacccccg

SEQ ID NO: 353971 - DNA, 573 bp, Homo sapiens
  misc_feature: GZ8MTXP02FFPJO.25.75.G09.1.454.CMB.2.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (414)..(414): a, c, t, g, unknown or other
  misc_feature (414)..(414): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttccngcaaggcttctggatacaccttgcaagtcatgctcttcattgggncgccacggcccccgganaagggcttgaggtggatgggatggatcaacactgccaaagttggtaatgactaaaactcgtcgaccccaagaaactcccgagggcagagtctaacgtttacgaggacacactccgagagtacgagctaanatacggacctaggagtcggccttagggtactactaggaagaccacgggcttaagtgttaattacgtggtgtagagaatacgagggtggggactccgttcgccgttacgaccgtaggtcggggaccgaacgggggtccctggtaccaccggtctaccccg

SEQ ID NO: 353972 - DNA, 649 bp, Homo sapiens
  misc_feature: GZ8MTXP02FNZRW.25.75.G09.1.454.CMB.2.raw
  modified_base (208)..(208): a, c, t, g, unknown or other
  misc_feature (208)..(208): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctnagtgtaaggtttcctgcaaggtcttcgtaggatacacctttcgcaagtcagtgtcttcttcagttgggtcgccgaccgaccggaccccccggagaagggtcttgaggtgagtgggactggactcgaaaacgctagacctaaagttggtaaactgacctaaaaatcgtaccgaaccaaagtaaaccgtccgaaggacgtaggacgtacgttaacgttacgaacgacacgtagaccgacgtaacgtaacgacgactacgacgtcggacgtagtacggtcgtacgttaggtacacgtagaacgacgtacggtattagttagttaagttagtgtagtagtacgtaagtaacggtagggtacggacgtccgttaccggtacctacggaacggtcggtaacggggacccggtacggggtaccgtcggtacccgaccgttccgtcccg

SEQ ID NO: 353973 - DNA, 571 bp, Homo sapiens
  misc_feature: GZ8MTXP02F04HH.25.75.G09.1.454.CMB.2.raw
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (522)..(522): a, c, t, g, unknown or other
  misc_feature (522)..(522): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttccngcaaggcttctggatacaccttcgcaagtcatgcttcttcattgggtncgccaggcccccgganaagggcttgagtggatgggatggatcaacactgaccaataggtaaatggacaaaactactacgaccccaagaaaactccccgaaggggcagacgtctaaacgtttacgaggggaacaacacgtacccgacgaagtacgaggctaacaagtcgggacctgagtcggaccgttggtactcgtagaaagactacgggactagtatagttactaggtgtgaactatacgaggtggggacncgtcgtcacgactaggtcgggacgacgggtacctggtaccgacgtactc

SEQ ID NO: 353974 - DNA, 726 bp, Homo sapiens
  misc_feature: GZ8MTXP02IPE73.25.75.G09.1.454.CMB.2.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctgggctgaggtgaagaagcgtgggcctnagtgtacggtttccngcaaggtcttctggataccncttcgnaagtcatgccttcttcagttgggtgccgccgacggcccccggaagagggcttggngtggagtgggatggatcaacnctcgactaagttgggtaatcgaactaaactntaccgaccagtaaacncccgagggactaggtactacgtaacgtttacgaacggacacgacgtacccggagtaaacgtaccgaggtaccctaaataacggtccgggtaaacctgggggtaaacgtcgggttcccgttagggttaaacgttccgtaaaagggaaccgtaccggaaccgggtttacttagttaacgggtttactttacggtttagggtcgttaaagggtaacgtaacggttaaccggagggggtttcggggaacggtttccctaccggtttaccccggaccgtacccggtttaggggttcccggggggaacccaccggggggttacccttaccggggtccttacccccgggtctttaacccccgg

SEQ ID NO: 353975 - DNA, 658 bp, Homo sapiens
  misc_feature: GZ8MTXP02F34SS.25.75.G09.1.454.CMB.2.raw
  modified_base (172)..(172): a, c, t, g, unknown or other
  misc_feature (172)..(172): n is a, c, g, or t
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgccccactcccaggtccagcttgngcagtctggggctggaggtgaagagccgtggggcctgagtgaaggtttccngcaaggcttcgnggatacaccttcgcaagtcatgcttnttcagttgggcnccgccgacggcccccgganaacgggctggagtggagtggatggactcgaacactcgaccaagttggtaaatgacctaaactagtcgacccaagtaaacctcccgaagggccaggtacgtacgtaacggttttacgaacggggaaccacgtaacgtacccgagtaacgtacgaacggacgtaaccgagtcggaactggaagttcggaccgttaggtactacgtacggaagacgtaacgggtactaagttgttaattccgtagttagtagtaacgtaacgtaggtacgggttaagggggacgtcccgttacggtaccgtaccggtacccgtaaggttccggggaacccgacgggggtaccctcgggtaccgacccgttccgtacccg

SEQ ID NO: 353976 - DNA, 607 bp, Homo sapiens
  misc_feature: GZ8MTXP02FW41T.25.75.G09.1.454.CMB.2.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttccngcaaggcttctggatacaccttcgcaagtcatgctctcattggtncgccaggcccccganagggcttgagtggagtggatggatcaacnctagccaagttggtaatgactaaactctcgacccaagaaactccccgaaggcagacgtcgtaaccgtttacgagggacacagtccgacgagtacaggctagatcgactgagtggccgtggtactctaggaacgacgacggactagtcggtttaattacgttgttagtagtagtaacgttacgagggtacgggggtacgtccgttacgtcccgttaccggacccgtaaggtttccggggggacccgtaaccgggggtaccccgttcgggtacccgtaccccggttaccgttccccgg

SEQ ID NO: 353977 - DNA, 710 bp, Homo sapiens
  misc_feature: GZ8MTXP02GGILZ.25.75.G09.1.454.CMB.2.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
tcagactgtacagtcacgaccggtgctcgatttagtatagacatcaggggacccaacaaccacatccctcctcagaagcccccagagcacaactcctcaccatggactggacctggaggatccttctttttggtggcagcagccacaggtgcccactcccaggtccagcttgtgcagtcgtggggctggaggtgaagagccgtggggcctnagtgaaggtttccngcaaggcttcgtggatacaccttcgcaagtcatgcttcttcagttggggtcgccggccgaccgggccccccggaagaaggggtccttaggacggtgggagttggggacttgggaactacgaaacactacggacctaaaagttgggtaaaactggaaacctaaaaacgtctaccgaaccccgaaagtaaaacccgtccccggaaaaggggcctaacggggtaccgttaaccgttaaaccgggtttttaaaccgaaacggggaacctaacgaacgttacccgacggtaaagtaacccgaaggtaccttaacgacgtacgggtaaccgtggtaggtccggtccgttaggttactacggtagaacgacgacgggtctaagttgtaacttgtaggttgagagtaatacgtagggtaggggctcgtcggtacctacgtccgtaggttcggggaccggtacgggtaccgtcggtccgtacggtcccttaccg

SEQ ID NO: 353978 - DNA, 609 bp, Homo sapiens
  misc_feature: GZ8MTXP02IQ50M.25.75.G09.1.454.CMB.2.raw
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (304)..(304): a, c, t, g, unknown or other
  misc_feature (304)..(304): n is a, c, g, or t
  modified_base (327)..(327): a, c, t, g, unknown or other
  misc_feature (327)..(327): n is a, c, g, or t
  modified_base (371)..(371): a, c, t, g, unknown or other
  misc_feature (371)..(371): n is a, c, g, or t
  modified_base (539)..(539): a, c, t, g, unknown or other
  misc_feature (539)..(539): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtgcccactcccaggtccagcttgtgcagtcgtggggctggaggtgaagagccgtggggcctnagtgaaggtttcctgcaaggtcttntggatacacccttgactaagtcatgtctcttcagttggtgcggccgacggccccccgagaacggctaggngtggagtggagtggactcgaacnctgacctaatggtaatgacaaactacgtacgacccaagtaaacncccgagggacagtacgtaccgtaaacgtttaacgacggggtacaacgaacgtcccgacgacgtaccgaggtaccctaagtaacgtcggtaaaccgtggtaacggtacgtcgttacggttatacgtagaacggacacggtatagttgtattgtagtgtagagtatacgnggtagggactacgtcgtccgtacgtacgtggtaacggaccggacggtaccgtgtccgtaccgtactcccg

SEQ ID NO: 353979 - DNA, 578 bp, Homo sapiens
  misc_feature: GZ8MTXP02HUVBJ.25.75.G09.1.454.CMB.2.raw
  modified_base (275)..(275): a, c, t, g, unknown or other
  misc_feature (275)..(275): n is a, c, g, or t
  modified_base (305)..(305): a, c, t, g, unknown or other
  misc_feature (305)..(305): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (492)..(492): a, c, t, g, unknown or other
  misc_feature (492)..(492): n is a, c, g, or t
  modified_base (514)..(514): a, c, t, g, unknown or other
  misc_feature (514)..(514): n is a, c, g, or t
  modified_base (575)..(575): a, c, t, g, unknown or other
  misc_feature (575)..(575): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtcgcccactcccaggtccagcttgtgcagtcgtggggctggaggtgaagaagcctggggcctcagtgaaggtttcctgcgaaggtcttcgtggataccaccttgcaagtcatgctcttcattgggtnccgccgacggccccggagaaggcttgaggngagtgggataggatcaacgctagacctaaagtggtaaatcgaacaaactcgtcgacccaagaaactccgagggctaggacgtactaccgtttacgaaggaccactcacccgngtagtaccnggtaccctagagttccgactggacgtgacctggtatcgtagaaacgcaggcttaggtatacttagngtgtagagtactagtacggggnggtactcgtccgtacgtacgtacgaggtccggacgtaccggctacggtcccgtaccgttcnccg

SEQ ID NO: 353980 - DNA, 612 bp, Homo sapiens
  misc_feature: GZ8MTXP02I32KJ.25.75.G09.1.454.CMB.2.raw
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
  modified_base (269)..(269): a, c, t, g, unknown or other
  misc_feature (269)..(269): n is a, c, g, or t
  modified_base (318)..(318): a, c, t, g, unknown or other
  misc_feature (318)..(318): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
tcagactgtacagtcacgaccggtgctcgatttagtatagacatcaggggacccaacaaccacatccctcctcagaagcccccagagcacaactcctcaccatggactggacctggaggatcccttcttttttggtggcagcagccacaggtgcccactcccaggtccagcttgtgcagtcgtgggctggaggtgaagagccgtgggcctnagtgtagtttccngcaggtcttgtgatacaccttcgcaagtcatgcttctctgtggtncgccgacggcccccgagaggtctagagtggagtggatcggatacgaacncgtacgacctaagttcgtaaatcgacgtaaaactacgtacgacccaaagtaaaccgtcccgaaggtcagtacgtctaaccggttanacggacagtacgtaccgngaacgtagagtactagacgtaggacctggtaagtcgtcgtagttacgtacgtaaggaacgtacgagggtacctaagttattaacgttcgtagtcgttagaacgttagaggtagggtaggacggtcctacgttccaacggtccgtacggttcggccggtaaccggtcccgtgtacccgtacgttccgtccg

SEQ ID NO: 353981 - DNA, 702 bp, Homo sapiens
  misc_feature: GZ8MTXP02HT4IP.25.75.G09.1.454.CMB.2.raw
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
tcagactgtacagtcacgaccggtgctcgatttagtatagacatcagggggacccaacaaccacatccctcctcagaagcccccagagcacaactcctcaccatggactggacctggaggatcctcttttggtggcagcagccacaggtgcccatcccaggtccagcttgtgcagtctggggctggaggtgaagaagccgtggggcctcgagtgaaggtttccngcaggtcttcnggatacaccttcgacaagtcatgctcttcgagttgggtacgcgcccgtacgggccccccggagaacgggtcttaggaggttggagtgggactgggaacttacgaaacgacgttacgacctaagtaggtaatacggactaaactctacgaccccaagaaaaccgtcccgaagggacacggtacgttacctaaggttttaacccgaaggggaaccaacgtacgtacccgacgtaaacgtcgaacggtactaccgtaagtcggtaacctagggagttacgccgttaagggttacttacgacgtaaacgaccgaacgggtaccttaagtacggttattacgtggttagtagacgtagtaacggagggttacgggaacgtccgttaccgtccgtaaccgtacccggtaggttaaccgggggaccggaaccggggtacccgtacggggtaaccctaccggtttcccgtacccg

SEQ ID NO: 353982 - DNA, 710 bp, Homo sapiens
  misc_feature: GZ8MTXP02IJJ8R.25.75.G09.1.454.CMB.2.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
  modified_base (342)..(342): a, c, t, g, unknown or other
  misc_feature (342)..(342): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccaatcccaggtccagcttgtgcagtctggggctgaggtgaagaagcctggggcctcagtgaaggtttccngcaaggcttntggatacaccttcgcaagtcatgctcttcattgggtgcgccacggcccccgganaaggcttgagtggagtgggatggatcgaaacacgtgacctaaagtacgggttaaancgacctaaaactactacgaccccaagtaaaacgtccccgaaggggaccaggtagttaccaaaccgtttttaacgaacggggtacaaacgtactaccgcgtaacgtaacaggactaaccgagttacgggtaaccttggaaacggtcgtaccgttacgggttacttacgtacggaaaggacccgtacgggtacttaaacgttgttaacgtttaccgtaggttggtacggtaagtaacgttaccggaaggttacggggggaacttccggtaccggttaccccgtaccggtaccgttaagggttcccgggggaccgtacccgggggtacccccgtttaggggaccccttaacccggggttcttaacccccgg

SEQ ID NO: 353983 - DNA, 663 bp, Homo sapiens
  misc_feature: GZ8MTXP02HL18K.25.75.G09.1.454.CMB.2.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtcgcccactcccaggtccagcttgtgcagtctggggctggaggtgaagagccgtgggcctnagtgaaggtttccngcaaggtcttnggatacacccttcgcaagtcatgctcttcgattggggtnccgtccgacggcccccggagacggtcttggaggtggagtgggatggatacaacgtctgaccaagtcggtaaatgaacctaaactgtccgaccaagaaacctcccgaaggacagtacgttactaccgtttacgagggacaacgcgtaccggacgtaacggtacgaacgggtcctaaccgaagtttccggggaacgttacgggtacgggttacggtccggttacgggtacttacggtaacgtaaggtaccacgggtacttaagttaccgttagttacgttgtagtagtaaagtagtacggtaaggggtggggtacctccggttcgtacccgtacgtaccgtagggttcccggggccggtacggtacccggtggtacccaccggtttctcccg

SEQ ID NO: 353984 - DNA, 604 bp, Homo sapiens
  misc_feature: GZ8MTXP02GOXRO.25.75.G09.1.454.CMB.2.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (413)..(413): a, c, t, g, unknown or other
  misc_feature (413)..(413): n is a, c, g, or t
  modified_base (508)..(508): a, c, t, g, unknown or other
  misc_feature (508)..(508): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagcctggggcctnagtgaaggtttccngcaggnttctggatacaccttcgcaagtcatgctcttcattgggncgccgacggcccccggaacgagggcttgnggtggatgggatggatcaacactgaccaagtgtaaangacaaacttncgtacccaaagtaaactcccgaaggggacctaggatacctacggtttaacacggggacacgtagtacccgngtaagtaccgaggtcctaagaatcgggaactggacgtggccctaggtacttcgaggaacacacgggacttaacgtggtaattacgtgttggtaanagtaagtacggagggtagggactccgtacgttaccgacgaccgtagggtaaccggggaccggtacgggtacccgtcggtaccgtacccgtcctacg

SEQ ID NO: 353985 - DNA, 651 bp, Homo sapiens
  misc_feature: GZ8MTXP02F4G6Y.25.75.G09.1.454.CMB.2.raw
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
tcagactgtacagtcacgaccggtgctcgatttagtatagacatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagagccgtggggcctcgaggtgaacggtttccngcaaggtcttcgtggactacaccttcgctaagtcatgctcttcagttggnccgccgacggcccccgagacgggcttgaggtgagtggatggatcaacgctggacctaagttaggtaatgaactaaacgtctacgacccagaaaaccgtcccaagggtcaggactactaacggttacgtagggactacgactcccgacgtacgtacgaacggtctaaacgtaacgtccggtaactacgggtaggtacgtacccgttagggtactacgtaacggaacgtaaccggaccggtattacggtattagttacgtagttgtagtaagtccgtaagtggggtaggacggtcctaccggtaccgtaccggaaccgtacggtcggggtcccgtacgggggtacccctgggtacccctaccggtccctttaacccgg

SEQ ID NO: 353986 - DNA, 644 bp, Homo sapiens
  misc_feature: GZ8MTXP02JA9M5.25.75.G09.1.454.CMB.2.raw
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
tcagactgtacagtcacgaccggtgctcgatttagtatagacatcaggggacccaacaaccacatccctcctcagaagcccccagagcacaactcctcaccatggactggacctggaggatcctcttttggtggcagcagccacaggtcgcccactcccaggtccagcttgtgcagtctggggctgaggtgaagagcctggggcctcagtgacggtttcctgacaaggcttactggatactacttcgcaagtcatgctcttnattgggaccgcacggcccgagaggctgagnggagtggatgactacaactacgacgactaagtgtaactacaactaactacgaccgaccctaaacgaaccgtccgaaggacacggtactaaccgttaacgttaacgaagacctaactacgtaccgacgtacgtaacgacgtactaacgacgtacggtacgtaggtacggtacgtacgttacggtataacgtaggtaacgacgtacgtacgtacgttagttaagttcgtaggttagtacgagtagtacggtagggtacgggtacgtacgttaccgtccgtaaccgtaccggtaacggggtaacggggacccggtaccggggtacccgtacggtaccctaccggttccgtacccg

SEQ ID NO: 353987 - DNA, 583 bp, Homo sapiens
  misc_feature: GZ8MTXP02FQBXE.25.75.G09.1.454.CMB.2.raw
  modified_base (236)..(236): a, c, t, g, unknown or other
  misc_feature (236)..(236): n is a, c, g, or t
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (411)..(411): a, c, t, g, unknown or other
  misc_feature (411)..(411): n is a, c, g, or t
  modified_base (475)..(475): a, c, t, g, unknown or other
  misc_feature (475)..(475): n is a, c, g, or t
  modified_base (501)..(501): a, c, t, g, unknown or other
  misc_feature (501)..(501): n is a, c, g, or t
tcagactgtacagtcacgaccggtgctcgatttagtatagacatcaggggacccaacaaccacatccctcctcagaacgcccccagagcacaactcctcaccatggactggacctggaggatcctctttttgtggcagcagccacaggtgcccactcccaggtccagcttgtgcagtctggggctgaggtgaagagccgtggggcctcgagtgaaggtttcctgcgaaggtcttgnggactacaccttcgcaagtcatgcttntcagttggncgccncggaccccganaacggctagagtgngtggatggatcagactgacaagtgtaanganaactnacgaccaagaacctccaggcagacgtctaaacgttcgaaggacaactacgtcgacctaaagtacccagggtanaacccgtagtacggctaaggcgtaggcccttagggtaaactgtaagaacgtacgacgggtactntacggttacttgtagttagacgtaanagtaacgagttcgggggactcgttaaacgtccgacggtacctagggttccggacggaacgtcgtcggctacccgcgtacccg
